United States Patent 10,724,096 (METHODS AND COMPOSITIONS FOR INHIBITING AND TREATING NEUROLOGICAL CONDITIONS) - sequence listing, part 5

SEQ ID NO: 27 - DNA, 18527786 bp, Homo sapiens (residues 2,058,644-4,117,286 of 18,527,786)
  misc_feature (4041202)..(4061201): n is a, c, g, or t
aaaaataataataataaaataaacttccctagtgaccagaattacattgcctaaccttgactaaactaaatgttgatgggtcaaagtgtattaaaaaagaaacgtggctgggtgcagtggctcacgcctgtaatcccagcattttgggaggccaaggctggtggattacctgaggtcaggcgttcgagaccagcctagccaacatggcgataccctgtctctactaaaaatacaaaaattagccgggcatggtggcgcgtgcctgtaatcccagctacttgggggctgaggcaggaggatcacttgaacttgggaggcagaggttgcagtgagccgagattgtgccagtgcactccagcctgggcaacagagcaagactccatctcacaaaaaaaaaaaaaaagaaagaaacgcttcttatggacaaagcagttggaggttggcttgtgggtaggctatccagggctggtatggcagcttcatggtatcatcaaaaacccataagcttaggccaggcatggtggctcacacctgtaatcaagcagtttaggatgcggaggccagaggatcacctgagcccaggagttcaggaccagcctgggcaatgtggtgaaaccctgtttctacaaaaaatcccaaaacattagccaggggccaggcacagtggctcacacctgtaatcccagcactttgagagaccacagccagaggatcatttgaggtcgggctttcaagaccagcctggccaacaaggtgaagccccatctctactaaaaatataaaaattggctgggcattgcattgccaagataatcctaagcaaaaagaacaacgctggaggcatcacgttacctgacttcaaactataccacaaggctacagtaaccaaaagagcatggtactgctaccaaaacagatgtatagaccaatgaaacagtacagaggcctcagaaataacaccacacacctacaaccatctgatctttgacaaacctgacaaaaacaagaaatggggaaaggattccctatttaataaatggtgctggaaaaactggctagccatatgtagaaagctgaaatggatcccttccttacaccttatacaaaaattaattcaagatggattaaagacttacatgttagacctaaaaccataagaaccctagaagaaaacctaggcaataccactcaggacataggcatgggcaaagacttcatgactaaaacaccaaaagcaatggcaacaaaagccaaaatagacaaataggatctaattaaactaaagagcttctgcatggcaaaagaaactaccatcagagtgaacaggcaacctacagaatgggagaaaatttttgcaatctacccatctgacaaagggctaatatccagaatctacaaagaactcaaacaaatttaccagaaaaaaacaaccccatcaaaaagtgggcaaaggatatgaacagacacttctcaaaagaagacatctgtgcagccaacagacacatgaaaaaatgctcatcactggtcatcagagaaatgcaaatcaaaaccacaatgagataccatctcacgccagttagaatagcaatcattaaaaagtcaggaaacagcagatgctggagaggatgtggagaaataggaatgcttttacactgttggtgggagtgtaaattagttcaaccattgtggaagacagtgtggtgattcctcaaggatctaggactagaattaccatttgacccagcaatcccattactgggtatatacccaaagggttataaatcatgctactataaagacacatgcacacacatgtttattgtggcactattcacaatagcaaagacttggaaccaacccaaatgtccatcaatgatagactcgattaagaaaatgtggcacatatataccatggaatactatgcagccataaaaaacgatgcgttcatgtcctttgcagggacatggatgaagctggaaaccatcatcctcagcaaactatcacaaggacagaagaacaaacaccacatgttctcactcataggtgggaattgaacaaaaagaacacttggacacagggtggggaacatcacacactggggcctgtcagggggtggcggcctgggggagggatagcattaggagaaatacctaatgtaaatgatgagttgatgggtgcagcaaaccaacatagcacatgtatacctatgtatcaaacctgcaggttgtgtgcatgtaccctagaacttaaagtataattttaaaaaaattggctgggcgtggtggcatgtgcctgtggtcctagctactcaggaggctgagatgggagaatcgcttgaacctgggaggcagaggctgcagtaagctgagatcataccactgcactccagcctgggtgacacagcaagattccgtctcaaaaaaaaaaatttattatttttttaaaatagtaaaatcactaaacttgtgcaatggtagcatggaaattatctgaggtgtactgtatgattgtattttaaccagggtggacatagcttaaattataaaaactaaagatgaaagtacaaggaagcacaagtataaattatacaagtataaattcatgctgcctacttctaagagaactttcattcttcataaccacataacattataatgccactgactcataaggggtttacattaattctatgggggagaacactagaattattagtgttcattttcatctaagatcttttttctctaacattcttggtcctattgaaacattgcagtatgcagaaatactgtaatgttaaacccaagagaaaagccattatcatgtgtacgctggtcatcatgatcagtgtggtacaatttaaaaaaataaactatcatgcccttcatgaaaaaaaaaaattacctgggcatgggggcacatgcctgtagtcccagccacttgggaggctgaggtgggaggatcacctgagacccaggaagtcgaggctacagtgagtgatgatggcgccaccgcactccggcccaggagctgctcatgttattttactggcttaacagtgttacggccaatgtctctgtgattctcttggccttttcctcatgattgtggcctcaaggaatgtattcttccatgagcaacgtgtgatcagcctctccgagtgaggtgccaagagtgttcccgtttaatatctcacaattaaatcagaactatttactgggcatcatttattaagcactgtttattaagcactttctgaatgccaggcaccttaaaaacattccctctaattctcacaattccctacaaagttgagattattatccttatttaaaagacaagaaggtgagaatctggaggttgaaatttttaatttaaaaaaagagagagagagggccaggcacaatggctcaggcctgtaatcccagcaaactttggaaggctgaggagggaggatagcttgagcccaggagttcaagactagtttcatagggagaccccatctcttaaaaaaatttaaaaattagaagggcgtggtggccacacacctgtggtctcagctacttgggacatttgagcttgggagttcaggactgcagtgatcgatgatcctaccactgtactatactccagcctgggtgacagataaaaaccctgtctcaaaaaaaaaaaaaaaagaaaaatgcttatgagcacagactgtgatggaaaggtggaaatgcgacacgtgaagcacagaggatggaggatggaggctggtaccacataggcccttggttgtattttcttttctttcttttttttttttttgttgttgttgttgttgagacggagtctctctctgtcacccaggctggagtgcagtggcgtgatctctgctcactgcaacctccgcctcctgtgccagaaggtgaaagataaaaagattgttatttataacaatcccttttcaaacacacttgagtttacgttaatgaaaggatttggggaaagttccaagataaccacaggatgacgggggctggcttccagaggatccaaccatttggtcagagggttggaagtttcagccccacccccaacctccagggaggggctcaaagtgaagttaatcaccaaaggccaattatttatcaatcatgcctacataatgatgctttttttttttttttttttttttttgagacggagtcttgctctgttgcccaggcaggagagccgtggcacgatctcggctcaccacaacctccacctcctgggttcaagagactctcctgcctcagcctcccgggtagctgggactacaggcgcacgccatcatgcccagctaatttttgcatttttagtagagacagggtttcactatgttggccaggctggtctcgaactcctgacctcgtgatccacccgcctcagcctcccaaagtgctgggattacaagcgtgagccaccacgtccggcctccttaagtgtattttcataatatacatactaaggaataccgtgcagctgttataaagaactagtaacttggctgggcaaggtgtctcacacctacaatcctagtactttgggaggctgaggtgggtggatcacctgaggtcaagagttcaggagcagcctggccaacatggtgaaactccgtctctactaaaaatacaaaaattagccgggcttggtggcatgcgcctgtaatcccaactacttgaaaggctgaggcaggagaatcgcttgaacccagagggcagaggttgcagtgagccgagattgcgccacttcactccagcctgggcgaaagagtgaaactccgtctaaaaaaaaaacaactagtaactctatatgtatctacatagaaaagaaacctcagccaggcacagtggctcacatatgtaatcccagccctttgaggggtggaagtagaagggtcacttgaggccaggagtttgggaccagtctgctaaaacataacaagaccctgtctctattttaaaaagaaagaaaaaagagagaagccaggcatggtggctcatgcctgtaatcctaatactttgggaggccaaggtgggcggattgcctgagctcaagagttcaagaccagcttgggcaacatggtgaaattccatctctacaaaaaaaataccaaacaaaaaaattagctgggtgtgatggcactcaccgtagtagtccccactactgggtagctaaggcaggaggatcacctgaccccaggagctctaggctgcagtgagccaagatcatgccactgcactccagcgtgggtgacagagtgtgaccccgtctcttaaaataaagaaattaattaatttaattaaataagaaaaaggagagagaaagagagaaaataaatctcttagtcacggggttaagtagaaaaagccagttgcagaacaacatggcccccatgtagagcaaaattatgtatttctacatgtttatgccacaaatgcataaaaataagatttggaagtgatcacggcaggaggcagacaaacgcctaggcagacggggcaggtccctggcgaaactccacctccaagacaaagacagcttgaagcctgaaagccaagctacaagtcaaatccacgaatgagactgagaacctgtcttcctatttggtgcgctttcctctgattggtccccacccttcacctagtttacatttacctaccctttcctaattggttttttacactgtccatgcccacctttgagtgatgtctttgctttaaccttttttgcatactcacaatcagcatgtagtccccattctgaggccataaaaagccccagacccagccacaaggagagagaaaccacccccacccccacatcccctctccgctgtgagctgttccgtcactccgtaaaattatctgccctcatcacccttcagtcctccacgtgacctcattcttcttgaacactggacaagagctcgggacccaccaagtgcgggtaccctgaaaggctgtcacactggccctctgcccttctaggacggcagctaccccacgtgacagggccaggggccgactgagctgctaacacaccgaccatccagggggctgtggacagtggaactaaaagagctaattagcacactaataccctctctggggcttcagggtcgcaggcatccttgcctggatgccgccatgtcccccttgaggcaatacacctggtgtgtccacgggcccgcatggagcttgctcctgtgtcagtgcttggagtggctggccagatcccgcactcactcacgtgctccctcctgtaagggggtgagtgcggcaggccaagtagacagggcgcccctgccgtgagtccaaaaaaagaaaaggctgagaaatatcctgcatcagaaggatataaaccacatttatgacctgttatctctggggcaaggattggcagaaaggggctgagtgtggtggttcacacctgtaatcctagcactctgggagactgaggcaggaggattgcttgaacccaggagtttgagacccccctgggcaacatagtgaaacctcgtctctgcaaaaaaaataaacaaaattagccaggtgtggcacacacctgtagtcccagctacttgggaggcttgggaggctgagatgggaggattgcttgagccctggttaagttgaggcttcagtgagctgagattgtgctactgtactccagcatgggtgacagagcaagacccagtctaaaaaaaaaaaaaaaaaaatagaattggcagaaaagccaaaagagaaatgttgctttttttcccctggactctggtcactaactacctatgtgatcttgagcagactgtagcacttctgtgcctcaggctccccatctgtaaaatagggacacattcgtagttacttgataaatggttgtaaggattaagtgagttaacatacataaaacatgataaaacatgaatagtagtgcctgctacaatgttggaattaaatttgttttcattcttctgtgacttttcatggtactaatggtactaaataatctctgtcttgctgggcatggtggctcacacctgtaatcccagcactttgggaggccgaggtgggtggatcacctgaggtcaggagttcaagaccagcctgaccaacatggagaaaccccgtctctactaacaatacaaaattagccgaggtggtggcacatgcctgtaatcctagctactcaggaggctgaggcaggagaatcgcttgaacccaggaggcagaggtttcagtgagccgagatcgcaccattgcactccagcctgggcaaaaagagtgaaactctatctcaaaaataataataataataataatctctgtcttgatcagaagttggggagagtctcccctcaccattccttcagggtcttatgcggaggaaaagctgttaaaaaaaaagtgtaaaggtcaaaagtaataaggaaatcatgccctctgcagggaagcagccaccatacccagcccacacggaacgtggctgtggctgagcagtgcccccagctcctgggtgggcctctcctcccttctaagagtttctgtaaaaagatttttgagttaaaaaaaaaagtgcaaaggattatattggagacagagggttaagacaatgacgctaggataaagacaagcctgtgggtggtggaaaagactgggttgtggggttgaggggggtccaagatccagtaggcctagaatccaagaacagaagctaattatcctagttcatcaaatttaagatccatcattgtaatatacaccactattttatgttctttttttttgagacagagtcttgctctgttgccaggctggagtgcagtggtggcgcgatctcggctcactgcaacctctgcctcccgagctcaagtgattctcctgcctcagcctcccgagtagagtagctgggactacaggcatgcgctaccatgcccagctaatttttgtatttttagtagagacggggtttcaccatgttggccaggcaggtctcaaactcctgacctcgtgatctgcccacctcggcctcccaaagtgctggtggcacaggcatgagccaccacccccggcctatgtactttttaaatgctgcaattagcttattatgtcattaactgttacatgcattccaatttcaaagatattaaaaggtaaacaaatgtgcatcatagaatcattaaaatatgagtccctaagcactgaaattggaaacaatgcccttgccccaattttttaaaatgtccctgaactgtaaaataaataaacataaggggatttccccaagatgattacttttaagttttatgagggaaaatggtaaatgtcaaattctgtccctaaaccatatctcatctcttttgttcctctgtaagggctgaatcagcctgttgggtgacccaggcctgccctgggggagggaggaaatccacacaactgagtcctttgagcctctcccctgccctgagttcagtagcagctggaaaggggcccagctttatgggggaacaatggtgccagccagcttcgggtgaaacaaggctgaacagcctggctgggtctggcctgggtccagaagagtgccccttgcacctgaggggtccgctccccttcagcaaaggacagatgaagccagggaaagtggagaaagaactccctgggctttctccgtgaacagctctctacgtagaatcccagaatcacccagccagaggacctcagtgtccatggaatcaaactgctccattgtacagatgggaaaacaaaggccccaaagggggctggagcttgcctaaggtccttcagtaagtcagtggcaaagctggagccacagtcaggttccctttaattcagcatgtctaccattaagtgcaagtctgtgcgatcttttgctgttttttgttgtttgtttgtttctgtcttttaaaaatgcccaaattggctgggcgcagtggctcacgcctataatcccagcactttgggaggccaaggtgggtggatcatttgaggtcaggagtttgagaccaggctggccaacatagtgaaaccctgtctctactaaaaatacaaaaattagccagcgtggtggtacatgcctataatcccagctactcgggaggctgaggcaggagaatcgcttgaacctgggaggcagaggttgcagtgagctaagatcacgccactgcgctccagcctgcgtgacagagagagactcctactcaaaaaaaaaaaagaaagaaaatgtcaaattatgttgcttgtacaaaatgtctgtctgacacatcagatagtgtctgactcacctgcccattggaatgagaagctcaggatctcaagcatgaatgcctccaggatagaggagacctgtgggtacatgcctgcccctactccttcaaactaatatttactgtgacatagtaacttcctggcttcaaagctcacctctaacgcttcccatgtatgtgaccttgggcaaattacttatcatcgtggtagtggcctccaagatggccctcaatgattctctcttcctacataaccaccaggctactgcagaaacaggtgtgacttctgaggccaggtcagaaaagacaatgcaaggctgggcacagtgtctcatgcctgtaatcctagcactttgggaggctaaggtgggaggatcactggagtccaggagattgagatcagcccaggcaacatagccataaaacgagacctcacctctactaaaaagagaaaagaaaattagcacctgtggtctcaacctacttgggaggctgaggtgagagaatcgcctgagcccaggaagtcaaggttgcagtgagctgagatgacaccactgcattccagcctgggcaatagagcaagaacctgtctcaaaaaataaaaacagccaggcgcagtggctcatgcctgcaatcccagcactttgggaggccaaggcaggcagatcacgaggtcaggagttcgagaccaccctgaccaacatggtgaaaccccgtctctattaaaaatacaaaaattaaccgggggtggtggcacgtgcctgtaaccccagctactcaggaggctgaggcaggagaattgcttgaacttgggaggcagagattgtagtgagccaagatcgcaccattgcactccagcctgggcaacagagcgagactccgtctcaaaaacaaaaccaaacaaaaaaacaaagagactgcagcttccatcttgctctcttggatcacttgccctaagggaacttagctgctatgttataagcacactcaatgttatatgctatgttataagcacagcccaatgcagggacacacacagcaagaagtaactgagactgcttgccaacagccaactgctttgccagccgtgtgcacgggcccgcttgaaactgtatcctccaaccccagtccagcttccagatgactgcagccctggtcaacatcttgaaacttatgagatgtttctggtgagaatcactcaactaatcagctcctgaattccttgcctatagaaaatacctgaggtaataaatgtttattgctgttttaagctttgtagttttggggtaattcctgacacagccacagacaatgaatacaatcacactttgcctccttttccttaaaatgaggatgatgggaggacttgctttatataatcatgaggattccatatgatacatgaaaagaatctggctaagctgggtgcagtggctcacgcctgtaatcccaacactttggtagcccaaggtaggtggatcgcttcagcccaggagtttgagaccagcctgggcaacacagtgaaaccccgtctctacaaaaaatacaaaaattagctgggcatggtgatgtgcgcctatagtcccagctactcgggaggctgaggtgggaggatcgcttgagcctgggaagttgaggctacagtgagctgtgattgtaccactgcactccagcctaggccacagaacaagaccctgtctcaaaaaataaataaaccaataaataaaaataagaagagtctggctcatagcaaatgcacagcagataggaaccaatattgctgtattattatatggtctccactaatcaagaggagaggttgagagctatatgaggaagggccaaaaggaaagatgaagtagcaacccccagtctcttcattttcctggcaattcagctctgactacattttcatagaacctcctaagacagaagccccatggggaaacttgatctccctagaaggcagtgtagggactatttatcactctgcaagcattccccttcgggtgctcagtcttcatcatccccaccactagaacttatcaactaatttcttgcttatctactaggagtccccagtcaacagaattgactccatctcagcactttccagggacattcccaacctctggaagctatccaacaaaggcttcctttgctccttaatttatctctgagaagcaggtttaaattttagctctgctgggttgggcacagtggctcacacctgtaatcccagtgctttggggaggatgaggcaggcagatcacttgaggtcaggagttcaagaccagcctggccaacatggggaaaccccgtctctaccaaaaattagctggtcctgtgatacactagcctgtagtcccagttactcaggaggctgaggttagaggatcacgtgaccccgggaggtggagattgcagtgagctgtgatggcgccgctgttccctagcatgggtaacagagtgagaccctatctcaaaaaaaaagacctaaacaaaaattttagctctgctaccgatttgtcctttgtcaagttactcaaccccttgagcctcatctcctcgtctgccaagcagaaatagcgaatatttgcttccgggttgttgggggaagaaaatgaagcaagacagcaaggtatgaatgctttattggatggaaataataaattgtcaatgcctccggactctcaggtgctgctcaacgccctgccctgccccaggaagcttctccccacagcggaagccacttagctctcacatgcaggctctgccctgtgctgggcttgacaccaactttggtggtttttgtttttgttttcaagatggagactcgctctgttgcacaggctgaagtgcagtggtgtgatcttggctcactgcaaccgccacctcccgggttcaagcaattcttctgcctcagcctcctgagtagctgggattacaggcgcccgccaccatgcctggctaatttttgtatttttagtagagacagggttttaccattttggccaagctggtcttgaactcctgacctcaagtgatccacccacctcagcctcccaaactgctgagattacaggcatgaaccaccaggccaggcctctgttttttttgtttgtttgtttgttttggtttttttttttgagacaaagtctccctctatcacccaggctgtatgtagtgcagtggcacgatcacagctcactgtaacctccacctcccaggttcaagcgattctcgtgcctcagcatactgagtagctgggaatacaggcttgcgccaccgcatcctgctaatttttgtattttttgtagagacggggttttgccacgttggccaggctggtctcgaacttctgatctcaggtgatccacccgccttgacctcccaaagtgctgggattacaggcatgagccaccactcctggcagctttgttttttaatcagggaactttttttttttttttttttgagacagagttttgctcttgttgcccaggctggagtgcaatggtgggatcttagctcaccgcagcctccgcctcccaggttcaagcaattctcctgcctcagcctccggagtagctgggattacaggcatgtgccaccatgcccggctaattttgtatttttagtagagatggggtttctccatgttggtcagactagtctcgaactcccgacttcaggtgatccgcccgccttggcctcccaaagtgctgggattacaggcgtgagccacagcacctggcttaatcagggaactttaaccagattttatctctttcatcaggggttcagcagtaactagcatatgtgcctgactgaatgcctccttcttatgaccaaggccagcttaagataaattatttttattcctatttatttatttattatttattattattactttttgagatagaatctcactctgtcgcccaggctggagtgcaatggcgcgatctcggctcactgcaacctccgcctccagagttcgcgccattctcctgcctcagcctccagagtagctgagactacaggcgcccgccaccacgcccggctaatttttagtagagacggggtttcaccgtgttagccaggctggtctcgatctcctgacctcatgatctgcccacctcagcctcccaaagtgctgggattacaggcgtgagccaccgcgcccggcctatttatttatttttgagaagtggtcttactctgtcacctaggctggagtgcagtagcgtgatcatggctcactgcaacctcgacctcctgggcttgagtgatccacaccactgcactccaccctgggctacagagcgagactccgtttcaaagaaaaaaaaaaaaggaagaaagaactcagggttggcagaacaagctgtagtgtctctgccttgcatcctggcatctcctctggcctgactccccagggtgattttaggagttgttcctacctatgcatagctcccaatactatggctttgcccctcatggagattctgtgagccacccaacatcctgtaataactctttcctgtttaaactgaagtgagttggtttgttttgtttgcaactaagaatcttgattgacacactgcataacaactctatcagtatgtgtaccatttgtattattttgaaataattttttatttaattagttttttaaagtaatgacagtcacttgtgaagccaccatcccaaaataaaatgtagaaccttaacaataacctacatctgactatatacctccctccccacccaacctctttcccaaccctagtaaccatcctcctgaaccttatgctcatcattccctgttgcacattatttttaattttctgttgaaatataatatacatataataaactgagcaaatattaagtgtacaattcaaataatttatgtgtgtgtatagatttttgtgtaaccaaatcaacatataaacatttcccgccaggtgcagtggctcactcctgtaacgccaacactttgggaggccgaggcgggcagatcacctgaggtcgggagattgagactatcctggctaacccagtgaaatcctgtctcttttaaaaatacaaaaaattagccaggcgtgttggtacatgcctgtaatcccagctactcagaaggctgaggcaggagaattgcttgaatccgggaggcggaggttgcagtgagctgagatcgcgccattgcactccagcctgggcaacaagagcaaaactccatctcaaaaagcaaacaaacaaagaaacatttcccatcccctagaagcctctcttgtgatctctcccagccaattcctgacacttgagagttaccagtattcttacctctgtcaccctaggtttgttttgcctgttcttttgttctttttttttttttttttgagatggagtctcactctgtcacccaggttggagtgcaatgtacaatctcgcctcgctgcaacctctgcctcctgggttcaagtgattcggtgattctcctgcttcatcctcccaagtagctgggattacaggcttgtgccactacgcccagctaattttgtattcttagtagagatgacgttttgccatgttggtcaggctggtcttgaactcctgacctcaggtgatccgcccacctctgcctcccaaagtgttgggattacaggtgtgagccaccgcacctggcctgttttgcctgttcttaaaacatttaaacaaagtaggcctggcacagtggctcatgcctgtgatcccagcaacgtagggtatattttagtacaaggcggaaggatcacttgagctcaggagttcaacaccagcctgggcaacacagcaagaccttgtctctacaaaaactttttaaaaaattagccagatgtggtggctcacgcctgtagtcccagctacttggggtgggctgatgtgggaggatcacttaaagccaagagtgcaagggtgcagtgagctatgatcacacactgcactccagcttgggtgacaaagagagatcctgtttcaaaataaataaataaataaaatagtaaagtatattttttatggtatgcatttttttggtctggcttctttcactatcattatgtttctgtaattctcctgtttttgcaagtagcaatagttgttcttgtttttttttctttctttttttttctttttttgagatggagtatcgctcttcttgcccaggctggagtgcaatgaatggcacgatctcggcccactgcaacctccgcctcctgggttcaagtgatactcctgccttagcctgccgtgtacctgggattacaggcgtgcaccaccacgcccggctaattttttttttgtatttttagtagagatggggtttcatcatgttggccaggctggtctccaactcctgacctcaggtgatctgccccccttagcctcccaaagtgctgtgattacaggtgtaagtcaccaggcctggcctcatatttttctttaaattgactcacttcatttattttatttaatttatttattcattttattttattttatttttgagacggagtctccctctgtcacccaggctggagtgcagtggtacaatcttggctcactgcaacctctgcctccctggttcaagtgattctcctgcctcagcctcctgagtaactggaattacaggtgcccactgccacgctcagctaatttttgtatttttagtagagatggggtttcaccatgttggccaggctgctctcgaagttctgacctctggtgatctgcccaccttggcctcccaaagctctgggattacaggtgtgagccacctggcctttttttgtgtttgtttttttttggggggggacatggtttcactctgtggctggaagtgcagtggcatgatgatggctcactgcagcctccacgtcctaggttcaagcaatcctcctacctcagcacccccacccctgagtagctgggactacatgtgcgagctaccatgcatagctaatttgtttttattttttgtagagacagggtctcactatgttgcccaggctggtttcaaactcctggcctcaaggaattctcctgcctcagcctcccaaagtgctgggataacaggcatgagccaccttgccaggctatttattttcttttttctttttgagatggagtgtcactctgttgcccacgctggagtgcagtgccgcaatctcggctcactgcaagctccgcctcccgggttcacgccattctcctgcctcagcttccccagtagctgggactataggcgcctgccaccatgcctggctaattttttttttttttggtttttgtatttttagtagagacagggtttcaccgtgttagccaggatggtctcgacctcctgacctcgtgatctgcccgcctcggcctcccaaagtgctgggattacaggtgtgagccactgcgcccggcctattttctaaataaaatagtttgaatactaatcatattcgtacatatgcctcattctttttttttttcccccgagacggggtcttgctttcttgcctacgctggagtgcattggctccatcttgtctcactgcaacctccgcctcccaggttcaagcaattctcatgcctcagcctctcaagtaggtgggattacaggtgcccaccaccatgcccagctaatttttgtatttttagtgaagacggggtttcaccatgctggccagactggtctgaaactcctgacctcgtgatccgtctgcctcagcctcccaaagtgctaggattacaggtgtgagccactgtgctcggccttttaaattttttcttcagatggtatctggccatgttgcccaggctggatttgaactcctgggctgaaactctcctcccgctgatagatgcaggaggcagataaggggaaggcctgcctgtacactggaagaacagggtggagccacaggaagttcgagctggatgcccggagagtagcctagcctctccagttcctgtgtggtggcctggtaatcaatttgctaggtaggggcccgttagcaggatcgcctctcgcctctcactttgctgagagtttttttcttttttccttttcacccagtgaattccattctcctcacccttcaatgtctccactttcctaattcttcctggttgtgtgacaaggacctggttttagctgaactaaggagcaaagttctcaacacctttgcctcctgagtagctgggattgcaggcttatgtcactatacctgccaccttcttcttctttttttttttttagttcctgcatagtttttctagtaccataatttatctagtcctctactgttgaacattgaccttatttccaatgtttacctattacaaacattgttatgacaaataaccatgttcatcagttattttgttcattgcacatttatctaagagataaatttttagagatgaaatggctaggaaccactggctggtttttcttttcttttcttttcttttctttttttttttttggcggggagggcagacaatcaacgttcccaggttgaagcctttttttttttttttcttagacagggtgtcgctctgtcacccaggctggagtgcagtggcaggatcatggctcactgcagccttaacctcctgggctcaaccaatgctcccatttcaacctccagagtagctgggacggcaggcacataccagcacacccagttaatttttgtgtattttatagagactggggtctccctatgttgcccaaactggtcttgaattcctgggctcaagcgatcctccctccttagcctcccaaggtgctgggattacagatgtgagtcacggcgtttggccgaggccttatatttgaagacatctttattttattttatgtattttattttatttttgagatggaatcttgctgtcgccgggctggagtgcagtggcgcaatctctgctcactgcaagctctgacttcctggttcaagcgattctcctgcctcagcctcccgggtagctgggattacacgcacgcaccacgcccagctaatttttttgtatttttagcagagacggggtttcaccatgttggccagcatggtcttgaactcctgaactcatgatccgcccccgccttagcctcccaaagtgctgggattacaggcgtgagccactgcgcccagccttgaagacatctttatagaggtataattgccataccataaaatgcacacacttttagtgtataattgaatgatttatagtaaatttattgagttgtacaaccaccatgaccagaaaaaacaaactcagtttctcccactatactcacaacaggcctctgacacaagatgtataggggttttccccacacatcaggcaatcagtcagttctgcagtggacaccagctgggtgttttctagtccaaataaactctgatactatccacctgaaaataacaccaggtcccataggttgagtgctcagtccccaagactatcctcacttcagatgccagtaataagtccaggcctccagaacttcaaactaaccagccataaatcaggattcccacaactccctccctgggttccattaatttggtagagggacttacagaactcagggaaacatatacattacaaacgctacaaataaacagccagatggagagaacaaagggtaaagtctgaaagggtctggagcacgggagcttttatccctatggagatggggtgtcacctcctcctcctgcgtgtggatgtgctctcattcaccttcctggaagcctacaggtgttcagctatttagaagctctctgaacccagtcgctttggtttataatggaagcgtcaggctgggcccagaggctcacacctgtaatcccagcactttgggaggcctaggcaggtagaccacctaaggtcgggaattcgagaccagcctggccaacacggtgaaaccccatctatattaaaaatacaaaaattagctggttgtggtggcaggtgcctgtagtcccaactacttgggagattgaggcacaagaattgcttgaaccttggaggtggagattgcagtgagctgagatcacgccattgcactccagcctgggaaacagagtgagactcttgtctcaaaaaaaaaagcatcattaggtaagcatgattgataaataattggccattggtgattaacttcacttagagaccctccctggaggttgggggtggggctgaaagtttcaaccctttgaactaatggttggatcctctggcagccactctcccatcctgtggttatcttggaactttccccgaatcctgtcattaacataaattctgccgggcgctgtgtctcacacctgtaatctcagcactttgggagaccaaggcgggcggatcatgaggtgaggagattgagaccatcctggccaacatggtgcaaccccgtctctactaaaaaaaaaaaaaaaaaaaaaaaaacaaaaaactagccaggtgtggtggcacgtgcctgtaatcccagctactcaggaggctgaggcacaagaatctctttaaccagggaggcagaggttgcagtgagtggagatcgcaccactgcattccagcctggtgacagagcgagactccctctcaaaacaaaacaaaatataaactcaagtgtgtttgaaaagggattgttttaaataacaatatttttatctttcaccttctggcactgaagctattccaagaggggtttcaaagatctaggacaaaaggccaaatattttaacaaaagattttttttttttgagacagagtctcgctctattgcccaggctggagtgcagtgatgcaatctcggctcactgcaacctccgcttcctaggtttaagcaattctcctgcctcagcctcctgagtagctgggactgcaggcatatgccaccgcacccggctaattttttgtgtttttagtagagacggggtttcaccacattggccaggctggtctcgatctcctgatgtcatgatccgcctgcctcggcctaccaaagtgctgggattacaggcatgagccactgcgcccagccaacaaaatatattcttattgctttagatacttcccttatcccccaagttggattaaatgctagctctagggctgggctcagtggctcacgcctgtattcccagcactttgggaggccaaggcaggtagatcacttgaagtcaggagttggaaaccagcctggtcaacatggtaaaacctacctctactaaaaatacaaaagttgctgggctcagtggctcacgcctgcaatcccagcactttgggaggccgaagtgggctgatcacgaggtcaggaatttgagaccagcctggccagcatggtgaaaccctatctttactaaaaatacaaaaattagccaggcatggtggcgtgtgcctgtaatcccaggtacttgggaggctgaggcaggaggatcgcttgaatccaggaggcagagattgcagtgagccgatatggcgccactgcactccagcctggccaaaagtgtgactttgtctcaaaaaaaaaaaaaaagtggccgagcgcagtggctcacgcctgtaatcccagcacttgggaggccgaggtgggcagatcatgaggtcaggagttcgagaccagcctggccaacacagtgaaaccccatctctactaaaaatacaaaaattagctgggcatggtggcaggcacctgtaatctcagctactagggaggctgaggcaggagaatcgcttgaacccaggaggcggaggttgcagtagctgagatcgcatcactgcattccagcctgggtgacagagctggactgtctccaaaaaaaaagtgctgttccatttggaagtcaaggctgatgccacctaagtgggttcctgctatcctgctacaaggaacttgaagacatcctctttcttcattggcaggacatcaagggctctggacattgtgaaagtttcccttgaagttacaatgggaatccagaacaacgtcacatggacccctccatgggtaacacagaaagcaaatggtgtcttttaagatacagaaaaatttgaattttgatggtttcattgaccaatttttccttttatagattaagcttttgttgtcatatctaagaaatctttgcctaacccaaggtcttgaagattttctcctatgtcttttttttttttttaagacaaggtctcattctattgcccagactggagtacagtggcaggatcacagctcattgcagcctcaacctcctggtctcatgcaatcctcctgcctcagcctcctgagtacctgggactacacacctgcaccactatgcacaaataattttttattttttgtagagatggggtcttgctatgttgcctatggttgtccacaactcctggatacaagcaatccttccacttcggcctcccaaagtgctgggattacaggcatacgccactgtgcccagtcctgacatatatttttaaaattttcatagatacagccaaattgtccttccaccacacaattggcatcacgtcaatttatactccaatcaggagtatggctgtttctcacttgcttggtaacactgttgagatagcaatttttttgttcctgaccaatctgatagtgaaaacatggcatctcatagttttaatagctaaaatcctactttagccacatcctaagcaatatgtgtgaaatgaccagctcgatgcattagccacccactgcttcagtatatacattactaaggaatgcaactgctaagataaaaagctaccacacaatctattgaaatactgacagaagaaattatatgatgtctgggatttgctttgaaataagccatcaatggaggtagtagatgaaactatttttctttctttttgagaccaagtcttgctctgtcaccaggctggagtgcagtgcatgatctcagctcactgcaacctacgcctctcaggttcaagccattctcctgcctcagcctccctagtagctgggactacaggcatgcgccaccacgcctggctaattttgtattttcagtagagacagggttttactatattggccaggctggtcttgaactcctgacctcaagtgatccgcctgcctcagcctccccaagtttgggattacaggcatgagccatcgcatccagccttttcttagagatgagggtctctttatgttgcccaggctgatctccaactcctgacttcaagtgatcttctcacctcagactcttaaagtgcttggattacaggtgtgaacaaacatgcccagtctgaaaactattgttactggtatttgaagcttatgacactagaaattcattatactgttttctcttttcttatctatctctgatatttttcacaataaaaacatatttttaggctgggcacggtggctcatgcctataatcttagcactttcggaggctgaagctggcagatcacttgagcccaggagtttgagaccagcctgggcaacatggcaaaaccagtctctatttaaaaaaaaaaaaaaaaagttatttatttattttttgagatggagtttcactcttgttgcccaggctggagtgcaatggcgcaatcttggctcactgagacttccgcctcctgggttcaagcgattctcctgccttagcctcccgagtagccaggattacaggcgcctgccaccacacctggctaatttttgttatttttagtagagacagggttttgccatgttggccaggctgctcttgaactcctgacctcaggtgactcacccgcctcagcctcccaaagtgctgggattacagatgtgaatcactgtgcccagcaaaagttgttttaaatgaccatttatggcaccacctaaaatcatcttgtgtacatctgtcactgcccaaccccttgaaagatgttggtttaaaggttcagagtgagggctctaggtcgggccgatcaaatgtgaatcctgattccatcaattactagctgatctcagggaagtcgcctaaccactctgggatagttgcctcagctgaaaaatcaacattaccgaaccaggttcgttctgcctgttgcacagtaagccaatcactgagatgataagttttgcagccaataaagagattattcacaaggcagcccagtgaagagataggagaacatgtctgaaatctgcatctctgaaaacagggtttagggatgtttatgggataaagaagcaaggtggtccaaggtgtagggaaaggtgattggaggtaaagaaaagtggggccattggtgatctgtgcaagccagttaagctttatggttcataggatgcatgttcagaaaatgacatcattagtacgatctaaggatggactttagggctttttggcactctaacattgaaaggtcacccatcagatactcaagcaggccgaggtgaagggtcggtgggctcagccatcttgaactggataagaactgactgtgagttcctgaaaaacaacttaagcaaccactgtcacagtgacctatacatcagagatgttatctataaggaagttgtggaagtctagttatatactgcttagctatgtgacttttagctatataggttttaaaatcaactagaagcaagtgactaaaaggaaacaaatcaaagcatgatataagctgattctttttttttttttttttttttttttttgagacagagtgttgctctgtcgcccagactggagtgcagtggcgcgatctctgctaaccacaagctccacctcccgggttcacaccattctcctgcctcagcctcccaagtagctgggactacaggcgcccgccaccacgcccggctaattttttgtatttttagtagagatggggtttcattgtgttagccaggatggtctcgatctcctgacttcgtgatctgcccgcctcggcctcccaaagtgctgggattacaggcgtgagccacagcgcccggcctgataaaaatttttaaaaggaaagaaaagaaaagcaagtaaggcaggttaagtttgtttgtttgtttttgagactgaaatctccagtgagaactttaggcaagaaattattcaggtctgtaatttgtagagataggccagtggggctttcctggaagaaggataactttaggtttgagaacaagaaaagaaggaactgaggataatgagcaggactagaagaagctctgacatgctgattattatctaaggctgttctttagtcttgcagttgcccctctgaagctcaaatctccccaaaattgcagggggatgtgctgagagctccttatggtgatctatttttataactttttttttttttgagatggagtcttgctctattgcccaggctggagtacagtggcgtgatcttggctcactgcaacctctgcctcctggattcaagcgattcttctgcctcagcctcctgagcagctgggattacaagtgcgcgccaccatgcccagctaatttttgtatttttagtagagacagcgtttcaccatgttggtcaggctggtcttaaactcctaacctcgtgatccgcccacctcacctctcagattgctgggattataggcgtgagccactatgcccagactttttctttctttctttctttttttttttttttgagatgaagtcttgctctgtcacccaggctggagtgcaatggcgcgatctcggctcactgcaacctccgcctcccaggttcaaatgattctcctgtctcagcctcccgagtagctgggattacaggcatggtatgccagggtaatttctgtattattagtagagatggagttttaccatgttggccaggctggtcttgaactcctgacctcaggcgatccatccacctcaggctcccaaagtgttgggattacaggcatgagccactgtgcccggcctataactttttttttcctacttctaattcagtatagaaaatttgaaggatacagaaaaagagactcttcctatcattgattcaggaagaggcagttgtgatgaagttgaaagagacaatcctgagttccaatctcagatctgtttcttgcattcactgtgaattttggccagtcactttagccttctgaacctgtttcttcctctatgaaagtgggaatcacagtgactcctacctcactgggtagctgtgggatgaataaaggcacatctagttcataaacacacggtgggcactcaatatatgtccttgtctcctcctttctgtttacagagaggtttcattcaagcatttcctgagcacccttaaggtgtcactacgtgccagaagacacatgagtatggacaagactggctctttctccttgaaaggcttatggatagtccaggctcagcgactcacgcctgtaatcccagcaccttgggaggctgaggtgggcagatcccctgaggtcaggagttccagaccagcctgaccaatatggagaaaccccttctctactaaaaatataaaattagctgggcgtggtggtgcatgcctgtaatcccagctactcaggaggcggaggcaggaggatcgcttgaacccgggaggcggaggttgcagtgagccaagatcgcgccattgcactccagcctgggcaacaagagcaaaactccgtctcagaaaaaaaaaaaaggcttatggtttggggagggaggaaggaggaaatcttcccagattaaatggtccaaactcctgcctcaagataaattaaaaaaaaaatacatttgacctcaatttccagatgtcagcagaggcccagagaggcaaggtcacatggcaaataaatagtaggaagggaacttgaacccgattaggaggaatattgggaaaagagcaaggaggaaggaactttgtaaataaagtcatgctagtttgtagcccaaaaaagaggaacaatagaagatggagctggctgcaaatggatcagggactggaaattcatctatgaaaatcgactgcattttttttttttttgagatggaatcttgttctgtcacccaagctggagtgcaatggggtcatctcagctcactgcaaactccgcctcacagattcaagcgattctcctgcctcagcctcctgagtagctgggattacgggctcatgcccccacactcggctaatttttgtgtgtttagtagagatgaggtttcaccatgttggccaggctggtctcgaactcctgacctcaagtgatccacccgccttggcctcccaaagtactgggattacatgcgtgagccactgtgcccagcctttttgggtttttgtttatatgtttgtttttgagacaaagtctcactctgtcacccaggtttgagtgcagtcgggcgaacatggcttattgtagccttgacctcctaggctcatttgatcctctcccctcagccttttgccaacacagctggctaatgtttttattttagtttagtagagacagggtcttactatgttgctcaggcttgggctgcattttgcttgtgcaagatttcctcccaatactatattatgaaaattttcaaacatataaagcagttgaaagaactgtatagtgaatgctcatctacccattacctagattctacaattgttaactgtttgctacatttgctttgttgcatatttattcattcatctgtttctccatctctcctcccatccatcttactattatttttttgagacagagtttcactctgtcgcccaggccagagtgcagtggcatcatttctgcttaccgcaaccttcacctcccagtttcaagcaatccttctgcctcagccacccaagtagctgggattacaggcatgtggcagcaagcccggctaatttttgtgtttttagtagagatggggtttcgccatgttggccagcctggtcttgaactcctgacctcaagtgatacacctgcctcggcctcccaaagagctgggattacaggcctgagccaccgtgcctggcctgtttatttattttttgagagagagtatctctttattgcccaagctggattgcagtggcaagatcaaggctcactggagcttcaacctccagggctcaagcagttctcccaccccagcctcctgagtagttgggactataggcatgagccattacacccagctttttttttttttttttttttttttgagacagagttttgctctgtcgcccaggctggagtgcagtggtgtgatctcggctcactgcaacctccgcttcccaggttcaagtgattctcctgcctcagcctcccaagaagctgggattacaggcgtctgcccccatgcccagctaatttctgtatttttagtagagacagggtttcaccaggttggccaggctggtctcaaactcctgacctcagtgctaggattacaggtgtgagccactgtgcccagtcccatctaatttttttgatttttgatgcatttcaaagaagttgcagagttcactacctctaaacacttcagcatgcctatcattaactacaatttactatttgtttctgaatttttggggttttgtttgtttgtttttgagacaaagtcttgctctgttgcccaagctacagtgcagtggcgagaccttggctcactgaaacctccacttcccgggttcaagcagttctcctgcctcagcctcccgagtagctgggattataggcacctgccaccatgcctggctagttgtttggtatttttagtagagatggggtttcaccatgttggtcaggctggtcttgaactcctgacctcaggtggtccatccgcttcggcctcccaaagtgctgggattacaggcgtgagccaccgtgcctggcctaggtgggtttttgttttttgttttgttttgttttgttttgtttgagacagagcctcactctgttgcccaggctggagtgcagtggcacaatttcggctcactgcaatctccacctgccaggttcaagcgattattgtgcctcagcctcccaagtatctgggatcgcaggtgtatgccaccacacctggctaatttttttttttttttgtatttttagtagaaacagggtttctccatgttggccaggctggtctcaaactcctgacctcaagtgatccgcccaccttggcctcccaaagtgctgggattacaggtgtgagccatcgaggctggcctaaatgttattttttattttacctggatggtcctaggaggcatttaactttattacccctgatctagaaagtgtattataaagccttggaagtagagttgccaaataaaatatagaatgcccagttaaattttaattttagataaacaatgagaaaaattttagtaatagtatgttacatgcaatagctgcacatatttatactaaaaattatctgttgtttatctgaaattcaaatttaactgggcattctatatatttattttctaaatctggcaacctgggaccacggacagaacttgtgtaccttatttcaaggagaagtaaacattcttaaacagaaataataagccatcacacctagccttaagtggtctctttggatccagatctcaggccctcagaagtctcgtggtgtcttctctccattaacacacagtttttcaaaccttcctctggcaagtgaaagcaaagaggctccaggaaagagggggacagcagtatgactaagtgttctgcagggaaatctggtaagaggcaggtggcatgtgggccgctggggtttttctcccaactccttccagctctgcatccctgcttcctgccctcctcctctcctaggaggcctaggaacctccttcccttgctggtgacaggctcctccaggtttctggcccctgctttagcagggctagtcctgtcctggattggcacaggtgtcataggcagaaggaaggtaaaggtggctcagttttatcaaccactgatcctgcattctgaccaggccaagaccaggctgagttctggatcagggaacttgggagctagaaccacatagcatgggagaatgaggaaatggccaggctgggattccctgccctcacaaactcggcttcttcttggacaatcaccaactacaaacccgggatgttctagaatctttacaacatcctaggaggtaggttctattagattcatttagagatttggatactgaggttcaggtgactttgcctaagaacccctgcccccccgcccccaccccacaagcaatttattgacataataaggactagatccttgatacatatgccgctgaagccgaaattactaactcctgttagatgctgcctcgcagatgagagctgacccatcctgttggcattagtaagaaggttaggatagcatagtccagtggttctcaaagtatcatgctaggtgggcatcagcattacctggaacttgttagaaatgtaatttctcagctcggcgcggtggcccatgcctgtaatcccagcactttgggagtcccaggcaggtggatcacctgaggtcaggagttcgagaccagcctagccaacatggtgaaaccctgtctctactaaaaatacaaaaaattagctaggcatggtggcgggcacctgtaatcccagctactcgggaggccgaggcaggagaattgcttgaaccccggaggcagaggttgcagtgagccgagatcacgccattgcactccagcctgggcaacaagagtgaaactccatctaaaaaaaaaaaaaagagaaatgcagtttctcggtcctaacagagcttcttgactcagaaattcctgggtgacacctagcaatctgagttttatcaagtccttcaggcgattctggtgcactataaagttttagaatcattgatatgtagtagaaagagatgccttttttttttttttttttttttttttttttttgagatggagtctcactctgtcacccaggctggagtgcagcggcacgatctcggctcactgcaagctctgcctcccaggttcacgccattctcctgcctcagcctcccgagtagttggaactacaggcacctgccaccacgcccagctaattttttgtattttttagtagagacagggtttcaccatgttagccaggatggtctcgatctcctgacctcgtgatccacccacctcgtcctcccaaagtgctgggattacaggtgtgagccaccgcgcccagctggagatgcattttttaaacaaaatgagtttcatttatttatttatattactattattagagatggagtctctctgtgttgtgcagggtggtctagaactccttacctcaaaggatcctcctgcctcagcctcccaaagtgctggaattatgggcatgagacactactcctggccaatatccatttaaaacatatatttgggaccgggcatggtggctcacacttgtaatcccagcactttgggagactgaggccagtgaatcaccagaggtcaggagttcaagaccagcctggccaacatggtgaaaccctgtctctagtaaaaatacaaaaaaattagctgggcatggtggcaggcgcctgtaatcccagctacttgggaggctgaggcaggagctaagattgcgtcactgcactccagcttgggcgacagagcaagactctgtctcaaaacaaaaaaatatatatttagaggctgagatgggaggattgcttgagcccaggagtttgaggctgctatgatcacaccattgcactccagcctaggtgacagagaccttgtctgtaaataaataaaaatgaaataaaataaaacatgtatttgttttaagtaaacttttattgatgtataatatgaatagagaaaaatgcagaaatcataagtatatggcttaattaattttcacaaagtgagaaagcctgtgtactgtcagaggcttttgaaccagagcaactccatcttgaataggggctgggcaaaataaggctgagacctactgggctgcatttccaggaggttaggcattcttcattctttttttcagacggagtcttactctgttgcccaggctggaatgcagtggcatgatcctgctcactgcaacatctgcctcctgggttcaaacaattctcctgcctcagcctcccaagtagctgggactacaggcgcctgccatcactcttggctcatttttgtatttttagtagagacagggtttcaccatattggtcaggctggtctcgaactgctgaccttgtgatccacctgcctcggcctcccaaagtgctgggattacaggcgtgagaggttaggcattctaagtcacagaatgagaggggtttggcacaagatacaggtcataaagaccttgccaaaaaagaagttagctaaaacccaccaaaacaaagatggcaattaaagtgacctctggtcatcctcactgctcattatatgctaattataatggatcggcatgctaaaagacactcccaccagtgccatgacagtttacagatgccacggcaacatccagaagttaccctataaggtctaaaaaggggagtaaccctcagctctgggaattggccacccctttcctggaaaactcataaataatccaccccttgtttagcatataatcaagaaataactctatccttagaccagcatctcgagccattgctctgactatggggtagccattcttttattcctttactttctttttttttttttagagggagtcttgctctgtctcccaggcaggaatgcagtggcaggatctccgctcactgcaacctctacctcctgggttcaagcgatactcctgcatcagcctcctgagtagctgggattacagacgtgcgtcaccatgcctgcctaactttttttgtatttttagtagagatggggtttcaccatgttggccaggatggtctcaaacacctgacttccagtgatccacccgcctcagcctcccaaagtggtgtgattacaggtgtgagccaccacgctcggcctcctttactttcttttttctttttctttttttttgagatggagtcttgctctgttgcccaggctggagtgcagtggtacgatgtcggctcactgcagcctccaccttgcctcctgggtcctggttcaagcaattctcctgcctcagcctctggagtagctggtattataggcgcacgtcaccacgcccagctaatttttgtatttttagtagaggtggggtttcactatgttggccaggctggtcttgaactcctgacctcgtgatccacccccctcagcctcccaaagtgctgggattacaagcgttagccaccacgcccggcccctttactttcttaataaactcattatcggctgggtgccgtggctcatgcctgtaatcccagcactttgggaggccgaggcaggtggatcacctgaggtcaggagttcaagatcagcctagccaacatggtgaaactccacctctgctaaaaatacaaaaattagctgggtgtggtggtgtgcgcctgtaatcccagttactcaggaggatgaggcaggagaatcacttgaacccaggaggcggaggttacagtgagctgagattgccccactgcactccagccagggtgacaagagcaaaactctgtctgaaaaagaataataaataaataacttgttttcactttattgtatggacttgccccaaattctttcctgcacgagatccaagaaccctctcttggggtctgaatcaggacccttttcctgaaacagtaacaccacccagatcagggcacagaacattattacctatcctgagaggtgtctttgtgccttcttccaggtacaccctcccctcaaagagtaaccagtatcctgacttctaacaccatagactagttttgcctaaccttacatagtttttaaaattgtaggtgaatacagaatctggagctacaggacttagggttagatccctggttcctggctgagtgatcttcaacaagccatttaatttctgtcacactcagttttcttctctgtataatggtcataaaaataccttgtactggccgggtgcggtggctcacgcctataatcccagcactttgggaggctaaggcgggcagatcacaagctcaagagttcaagaccagcctggccaatatggtgaaaccccatctctacaaaaatacaaaaattagtcagtcgtggtggcatgcacctgtaatcccagctgctcgggaggctgaggcgggagaatcgcttgaacccgggaggcagaggttgcagtgagcggaggttgggccactgcactcaagcctgggcgacagagtgagactcagtctccaaaaaaaaaaaaagcaaattctcaggccctgccccagacctactgaatcagaaactctaggagtggcctcagcaacctacagtttaactaactttgcaggcaattctgataagtactgaggtttgaaaaccactgcactagagaaactgaatgaggatggggcgcaggaatctgtattttagcaatctttcctaaggcatgttgcaggaaacatgaagtggttttgaaagtactttgcttgaggcttgaaggcttgaacctaggagtttgattttttattttttttagatggggtttcactctgtcactcaggatggagtgcagtggcgtgatcttggctcactgcagtctccgtctcctgagttcaagcaattctcccaccccagcctcccgagtagctgagattacaggggtgtgccatgcccaactaatttttgcatttttttttttgagacagattctcgctctgtggcccaggatggagtgcagtagcacgatcttggctcactgcaacctccgcctcccaggtccaagcaattctctgcctcagcctcctgactagctgggattacaggcacccgccaccacgcccggctaatttttgtatttttagtagagatagggtttcaccatgatagccaggctggtcttgaactcctgatctcgtgatccgcccgccttggcctcccaaagtgctgggattataggcgtgagccaccgtgcccggtctaatttttgcatttttagtagagatggggtttcaccatgttagccaggctggtcttgaactcctgacctcagttgatccatccgcctcggcctcccaaaccatgcccaacaaatttttgcatttttagtagagacaagatttcaccatgttggccaggctggtctcaaactcctgacctcaggtgatccacccgcctcagcctcccgaagtgctgggattataggagtgagctactgcgcccagcctttatgtttcttttgttgtttgttttttgagacagagtctcgctgagtcgcccaggctggagtgcaatggcgtgatcttgggtcactgcaacctccccctcctgggttcaatcaattatcgtgcttcagcctcccaagtagctgggattacaggcacccgccaccacacctggctaatttttgtgtttttagtagggaaggggtttcacaaggctaggcgtggtggctcacccaactctactaaaaatacaaaaattagccaggcgtgatggcatgcgcttgtagtcccagctacttaggaggctgagacaggagaatcacttgaacccaggaggcgagcggaggttgcagtgagccaagattgcgccactgcactccagcctgggcgacagagcaatactctgtctcaaaaaaaaaaaaaaaaaaaaaaagagacggggtttcaccatgttggccagactggtctcaaactcctgacctcaagtgatttgcctgccttggcctccctaactcctgggattacaggtgtaagccactgaccctagccaagcctaggagtctgagaacagcctgggcaacacagggagtccacgtctctacaaaaataaaaacaattaggatagtgtggtggcttgagcctggagtcccagctactcaggaagctgaggtgagaggatcacttgagcccaggaggttggctgcagtgagctatgattgcaccgctgcactccaggttgggtgacagagcaagactctgtctcaaaaaaaaaaaaaaaaaaaaagtcactttgaaaaatgtgactttccagatggcaaaatactattttcattaggaggaaacaggctaaacagtaatagcaaaggtcactaagtattgagcacttagtcatacctctgagtctctgcctgcatagcctattatttctcacaagcaatccatgaagaaggttaagacaacggactttcacgccagactgcctgggttcttatcaagtatgtgacttagtttatatatttgtaaaatggggataataatggtatttctgtaataggtttgttgtgagaataaagggagcttggtatcagctcttagaataccggacaggccacgttggctccactaagctgttgtcatcatccctaagggcacccagttaaaaggtagaaaagggaggatttgaatccggtcagtgtaactctcaagtgtacattttttttcttttattttctttttaaccacgccctttaatgtacattgttaaaggctaagccaggccaggtgcagtggctcacatctgtaatctcagcgattgggaggcccgaggagggagtatcgcttgagcccaggagctggagaccagcctgggcaacatggcgacaccgtggccctattcccgccccatcccatccgcactccaccccatccccatctctacaaagaatagaacaaaattagtcgggtgtggtggtgctcaactgctgtcccagctactcaggaagcccaggtgggaggctcgcttgagcccaggagtgtgaggctgtagtgagctatgactgcaccactgcactccagcctgggtgaagggtgagaccttatctcaaaaagaagaaaaaaaaagaaaaggaaaagaaaaagaaaaaagaacaactaagttataaactaagctatatagcccattggttctcaaattatgatttcactcactagcagtatcactagacagcttgttggacatgcaaattatcagaccctatcctcctatgccagatcttctgatcagaaactctgggggtgggggtcagcagtgtaagttttaataagctctctaggtgattctgatgcacaccatagtttgagaatcacagtccttataggctctggtgggcggggtgttaaaaaaaaaaaaaagcctggaggtgctgggagccgctcgcgcccatctcacctggagctgaggaaaactgggatttaactgatttaccaccgcagccagctcttcaagccaggggcgggccggacggctggcgcgcaaggcctgctggggcttgtagtctagaccacttccgcgctcaggcgcctgcgctttagctgctaactcgctctagtagctgtggtcggggctcgggaccggctgccatcttagtctagggactgaggagtcgccgccgccccgagtcccggtaaacccccgtgggcgaactcggggcagttctcgggagagggagggagtccggatgagaatgttcggggagaacaagggtagaggagtgggacgcgcggttcgggaccccagagccgcggctgctccttcttccagagccggtgtctgtcgggggcgcggggagctcgggctactggcccgggccgggcggtgggggtgggctgtctggacgttcggagggatcagtgtctggcacaggcttccggaggccttcgcctcgcgggctccaagttgtgaaagggctgggccacgacgggcgtgggtaccgtccggcccctcgcccctcagccccgcctggggccactctccagcggttcggcctacgcgcggggcccggcggcggggccggcgcgggcgacgtggccctgtgaggggcggcggccgggtcccccgccacccagctggccttctcgagacttttccgagcccccagtcgctagaagggcccagcacagcggctgcctccccttctctctcccactcgcctcctccttccattgtccccccggcgtggtggtcccggctccggcgccctccccgacgtccgccaccgtcgtggcggcgccgacttttgcagacgtggagctgtcactgcccttcctccggagagtgcccttttctttagcagagaaaagaaaaaagtagccgttgaacgtattctaagggtcgaagcatgatgacatgacttttaagtggagaactcaagttttccaagacagttcccgtccgcgacagaaaagagaatcgcagaatttgtgcgcccgaagtagacgctgggcctaaagttagttggacatgtaaccaggtgaacttgtaaagggccaggaattcattatccccaataacaacgcaaccttgttttcttggttgtattcgtatcctaatcttattacattttctgccattcttccacagctacagtatacttggtttggagtgggggatggggaattgtgggatttttgccttgaaaattagtaagaccctggagccagccacccacttaggtgggttctcctgcatcttttcctgatagaattcgatcttcaggaagtatgtaaaggcagtgtatttccattctcaaaatcggctaaggaatggtttatcagttgaggtgaagttctcatggcagatctgctgagagcttgctatgtgtatttacaggtttatttaagctacgatttatttttaaaattaagaaatgggccgggtgctgtgtgtggctcacgcctgtaatcctagcactttgggaggccgaggcgggcagatcatgaggtcaggagttcgagaccatcctgaccaacatggtgaaaccccgtctctactaaaaatacaaaaaaaaaaaaaaaaaaatcctgggcgtggtggcgcgcgcctgtagtcccagctactagggaggctgaggcaggagaatggcttgaacccgggaggtggaggctgcagtgagccgagatctcgctgctgcactccagcctgggcgacagagcgagactccgcctcaaaaaaaaaaaaaaaaaaaaagcaatgggatgggtgtggtggctcacgcctgtaatcccagcaatttgggaggccgaggtgggcggattacgtgagcccaggaattggagatcagcctgggcaacatcgtgaaaccccgtctctacaaaaaatacaaagatttgccgggtgtggtggcaggcgcctgtggtcccagatactcaggaggctgaggtgggggaatcacctgattccggggggtcgaggctgcggtgagctgttaccgttgccactgcattccagcctgggtgacagagtgagaccctgtctcaaaaaataaaaaaaaaaatttagaaatgaaggtggaaattctactgcttctttgaactgtgaatttaagttttgtgagtccaaaaggaattccattacattcagcatacaggtcaagtcaccaaggatatcatatgaaattaaaaaaatgagtacagactacttcttcagtgtattctagaatcaaacatttctacattctttagaaaaaaatacatctttttcgtttgtttgagacggaatctaactttgtcacccaggctggagtacagtggtgtgatctcggcttactgtaacctccgcctcccgggttccagcaattcttctgcctcagcctccgtagtagctgggactacaggcgcgtgccaccactcccggtaatttttttgtattttttagtagagatgggttttcaccatattggctaggctgctctcgaactcctgacctcgtgatccacctgccttggcctcccaaagtgctgggtttacaggcatgagccgccactcctggccctaaaaaatacatcttttcacttattgggagaggcagacaaaccagtagtccccaaatttgaccattagaataattaggagagcttagaaattccagggtcttaccttctgagatggatttagtaggtctgggttggcttcaaccaatttatttttaacacatgccttaggtaattctgatggtcttgggaaccactgagggcaaatggtactgtagacttaccaaggaaaggtcaaaaagctttgagacgaaagaggaagtggccaattctgtgtgtgtggctgggtggaggattggttagaagaggcaagatttgcccctgaacccacattgggtcttacatgaagagtaggagtgtgaaaagggcggggaaagagaaggacagggtaggctgagtgaatgccttaatgctgtgtgtaaattcagaggattatggaacaaaaagggttcagggagtgtggagtggaatggggaaggagagcattttgaaacgcaaggtcagaaaggttaaaggaagcaagtatatgaaaagtgattttttgttgttgagactgggtctcacccagtcacgcaggatggagtgcagtgacaggacctccagagctcaagtgatcttcccaccccagcctccctgagtagctgggacaacaggcatgcattagcatgcctggctaatttttaaaatttttttgtagagaaaggttctctttacgttgcccagtctggtcttaactcctgtgttcaagtggtcctcccaccttggcctcctaaagtgttgggattacaggtgtaagctactgtgctctggctaaaaattttaagtataatgctaaaaatttggaattttatgttggtagaaatagatacagggctgggctcagtgcctcacacctgtaatctcaacagtttgggaggctgaggcgggtgaatcgcttgagctcaggagtttgagaccagcctgggcaacatggtgatatcccgtctttaccaaaaggaaggaaaaaaaaaagaaatagatgcagatttttcgacagggaaatgatgtgagtacatatgtgttttagaaaattgctgtgtactgcaggacaaagataggtatcaaaaaacaaaaaaagaaagattgctctggtgatgagcgaaaggatgagggactagctattgcagaagtctagttgagaaatgacaaagcctgaccttggagagaggttgtggggatgatcaaaggattggatttagctttttactagtgcaatattgttgccatatttctagatgaggatttttttttagagctaatctgggtaaagggctccttttctgtcaaaagaacccattagcaagtctgaataatattgccaggttatatatgttatgtatagtatgagagtgaattgttcattagcatctttgagaaattagaaagaactatgtcaggtgtaatttggaagagaacttgaagtttgttattgttactatttttgagatggagtcttgctcggccatgcaggctggagtgcagtgatgtgatctcggctcactgcaacctccacctcccgggttcaagcgattcgtgtgcctcagcctcccaagtagctgcctcccaagtagctggaattagaggtgcatgccaccaagcctggctaatttagaacttggagtttggactgaaatttatgcctctaaaaagtattgatctaggcttgttgggagtgtttttctctcagcctgtagaaacttgctcattgagttttagagttgggagaagttacagagattatctagtccataatggcaaatatattttggtttattggccagctctaattggaagctgccagaagcactgtgtttggaaggattctggttgtaggtgctctgagaaattgtattatggttgatcaatgatgtctcctgtggacagttacctagtaggtagtagacatgtgccaaatatatgctattcttagataagtccaatctcttagttttctgttttgttgttgtttgtttgttttaaaggttaaataatttacctgaaactagttaagagtaagaactagaactagaactgggttttgcaactctgggactggtattctctggtttacaaagatcaatgtgcactactgaagagcttctggtattagactagaaaaagaaaagggagatttttagcctatgcgtcttgactgtttaggcaagagtttaacaaggaattttggcctagaagtaagttttgttatattcattctgtcttaagaaatttgtgttagggccgggcgcggtggctcatgcctgtaatcccagcattttgggaggctgaagcgggcagatcacgaggtcaggagatcgagatcatcctggccaacgtggtgaaacccccatctctactaaaatacaaaaaattagctgggtgtggtggcatgcacctgtagtaccagctacttgggaggctgaggcaggagaaccacttgaacctgggaggcggaggttgcagtgagctgagattgtgccactgcactccagcctggcaacaagaatgagactctgtctcaaaagaaaaaaaaaaaaaaattcgtgttagtactgataggaaatagtcatctgttttgttgttttgccactttctttcttgttgcctaagtctctgttttgggttttggacattggtttcctttataagaattaagacaaaagtatgtaaggtttttttttttgtatttatagtacttagccaaattctgggctcataataagcactcagtaaaggcatgttgacttttatggctgtaaatgatactggctttgagtcaatataaattagttagggggttcacagaattgaattgcagcattctctggttgggaggttggctttcagctaaaaacgttaagttggaaactatcctcacaactagaagcagttaaccagaagctgttcctgcctctatcctcctccagtctagcagtgtactgtccttgaaaaactgctgccagctcagcttttttgcttcttttcagaactgactatatccagatccttggtgtgcgttttcttttcctgtccctaggagtctccaagttgcagggactatcattatggtgacccttataggctggtgtatttatatggccatcctcattttgccagatagccgtcatactcagattggtgtcttcccataatacgtatgaatcattttccctcagttctttcttttgtcctgtctgctccattaaaaattgtctatcccatgaaatttttaaaagagactttgtgcttttagagtcgcaaggtcgttgcagatctgatgtgtttaactatagaggtcagctgggtgtggtggctcacgcctgtaatcccagcactttgggaggctgaggtgggtggatcacgaggtcaggagttcaagaccagcctgaccaatatggtgaaaccccatctctactaaaaatacgaaagttagccaggcgtgggggtgcacgcccgtagtgtagtcccagctactcaggaggctgaggcagaagaatcgcttgaacccaggaggcgaaggttggagtgagccaatatcatgccactgcactctagcctggcgacagagcaagactccatctcaaaaacaaacaaacaaaaaaatatagaagtaatgtgttaatggactctccttcctttctcaggtaccatgcatttcacggtggccttgtggagacaacgccttaacccaaggaagtgactcaaactgtgagaacttcaggtatggtgtcatcctgtgagagaaattgggggcaagagtgatgcagaggccaagctctggtcttatacctgctgtgaggagagagcagtgttgatgctagctgcatcagttggttgaacatataggcagcttcacttggttctgaaacccaaagctgcctctgcagggattagcctgtgagccacactgtgctcttaatttgggttttctgacttttctgtttttgtagatcccttatacatatgcatactttttctatttgtgttgttttatacacgtttatctctgtatactatctagacatgtgcatgtgtaggattaagaggtgggtaatgaaaaagaagacaacatggccaggtgcagtggctcatgcctgtaattccagcactttgtggggcgaaggtgggaggatcacttgaacccaagagtttgggaccagcctggacaacatggcgagaccctgactccacacaaaataaaaaaaaatcagctggtgtggtggcgtgtacctgtaatcctagctgattgggagggtgacatgggaggatcacttgagccaggaggttgaggctgcagtaagccatgatcacgccactgcactccagcctgggtgacagagtgagaccctgtctcggaaaaaaaaaaaaaaaaagacaacatggttcagtgcagaaagaatagaggacttggaaagaaaagatctgggttccgatttgattttgccactgacaagctgtgtgactttcggcgagttatttaatcttgccagacctcagtttatacatctgtaaaataggtaagtattgattcctgtctccatccctggcattgttgtgtggatcaaataaaataatacctattaaatctttagaaaaggaaatgaattcatgacttaaaatgttatcttggccaggcacggtggctcatacctgtaatcccagcactttgtttgggaggccaaggtgggcggatcacttgaggtcaggagtttgaaaccagtctggtcaacatggtgaaactccatctctactaagaatacaaaaattagcagggtgtgatgtcatgtgcctgtattcccagttacttgggtggctgaggcaggagaatcatttgaacccaggaggtggacactgcagtaagccaagatcgtgccactatactccagcctgggcaacagagtgagagtctgtctcaaaaaaaaaaaaaagaaaagaaatgttatctagatccacaaggtgagagaagttgagagtagtattgtgaaggaaaacatgaggacaagacagatcactttaaaaggtcaggagagaaggaagactactgggtaagaaaaaaaaagtagaacataaagttaagcagtaagagaatagggagtgaatgaagttgagcaggtgaattgttagataagaaagctgaggctgggcgcggtggctcacgcctgtaattccagcactttgggaggccgaggcgggtggatcacgaggtcaggagatcgagaccatcctggctaacaaggtgaaaccccgtctctactaaaagtacaaaaaattagccgggtgtggtggcgggcgcctgtagtcccagctactcaggaggctgaggcaggagaatggtgtgaacctgggaggcagagcttgcagtgagccgagatcacaccactgcactccagcctgggcaacagagccagactccgtctcaaaaaaaaaaaaaaaaaaactgaataggaagatactggtaaaatagaactaaaatatgatccagcattgccacttttgggtatatatccaaaggaaataaaatcacttcttctttttttttttttttttttttttgagatggagccttccccaggctagagtgcaatggcacgatcttggctcactgcagcttctgccccctgggttcaagtgattctcttgtctcagcctcctgagtagctgggactcgggaggccaggcgtgcacccaccacacctggctaattttgtattttcagtagagacggggtttcaccacattggccaggctgctcttgaactcctgacctcaggtgatctgcccgcctctgcctcccaaagtgctgggattataggcgtgagccactgagcccggtcctgttcttttttataatcaagagaaaggaaggagatggtggaatgatttgtgatagctactataaagcaatttaaaaaatatttaaaagtattattaaagtatttaaaatatctttaaaatatttctcagcatatccatttcatctcaagctcacaaagcagttctttgtggaaaggtatttgagccaacattcaggaaacctgcgttctaccattggtattactggtcacttaaattctgtgatcttgggcagctcacttaaatctccctgggcctggtttcctcacttatctattgaatgttttgaatatgatttctcaggttctttccagctcactctattatattctgtgctttatgtgctaactcactgatttttcatggctttgttgacatcacaatatatgactgatatcagaaatatcttataataaggcttcggccggccgcggtggctcatccctgtaatcctagcactttgggaggctgaggcgggcggatcacgaggtcagaagatcgagaccatcctgactaacatggtgaaaccccgtctctactaaaaatacaaaaattagctgggcgtggtggcgggcgcctgtagtcccagctactcgggaggctgaggcaggagaatggtgtgaacctgggaggcggagcttgcagtgagccgagttcacgccactgcactccagcctgggcgacagagtgacagagggatactttgtctcaaaaaaaaaaaaaaaaggcttcataatgtctgatgctttataaatgagaaaccatgttattttaagttctacttttttttttttttgagagggaatctaactctgtcacccaggctggagtgcagtggcgcaatctcagctcactgcaacctccgcctctcgggttcaagcaattctcctgcctcagcctcctgagtagctgggattacaggcacccgccaccatgcctggctaattttttgtatttttagtagagatggggtttcaccgtgctagccaggatggtctcgatctcctgacctcgtgatctgcctgcctcagcctctcaatgtgctgggattacaggcatgagccaccgtacccggccttttaagttctactttaaacattggcactgagagacctgtaggaaacgtaagtatagaaagtttaagtttgtaatatttgacaaggatctgttgagctgctattgtgctaggttccaaggggtactcaaatataaaactcctggtttaaggattttgtcaggaaaacagacttccttgccagtgattgattattataaaaaggaagttggtaaatgttacaagagtttcattgcattgcaatttaagaaattaagttcagattttttggttcctttaacatgattgaatgtattccttttttttttttttttgagacggagtttttctcttgttgccgaggctggagtgcaatggtgcaatctcagcttactgcagcctccacccactgggttcaagcgattctcctgcctgagtctcccaagtagctgggattataggcatgtgccaccacgcccagctaattttgtatttttactagagatagggtttcactgtgttggtgaggctgatcttgaactcctgacctcaaataatccacctgcctcgacctcccaaagttctggattacaggcataagccactgcacctggccaaatgtattttttttttttttttgaggcagagtcttgttctcgcccaggctggagtgcagtggtgtaatcttggctcactgcaacctccgtttcctgggttcaagccattctcctgcctcagcctcctgggtagctgggattacaggtccctgccaccatggccagctaatttttatatttttactagagatggggtttcaccatattggccaggctggtctcaaactcctgacttcaggtgatccgcctgccttggcctcccaaagtgctggaattataggcattcggcctaacataattgaatgtattttaagtgctgctgtatgctagacattgcagggacttatggtgaaaaagcaatctctgccctccagcaactcgcattttttttttccatgtctggaaattgcttaccctaatagatctatccttctgtcccagaaaagagaagaattttaatactatgtcgtcacttacaggttaagaattcatctacatattgagcttaactcactccagaaatatctactaacttgcttgctttctgagaaaatgtttattattttactggattctgcaaccttttctttgtcagttacaagagaacattttttttttttatttttttttaagatgcagtcttgctttgtcgccaggctggagtgcagtggcacagtcttggctgactgtaatctccgtctcccaggttaaagcgattcccctgcctcagcctcccatgtagctgggactacaggtgcccaccaccacgcctggctaattttttgtattttagtagagacgaggtttcaccatgttggccaggatggactttttattttttatttttttaagacaagataagctccagaaataaccatctgcatttaggtgaactttgatttgcttgttaggccttcattcgtgcaaagaaagagtaggttctacaattttgtcttgattatttttccaaataatcaaatttagttggtcacaaaggaaaggattttagtctaaaggattatattgtaggagttaacagtatttactggagttaggttgattttgaattttgactctactgtgtagtggtggtatgatcttggccaacttgcctaacttctttttgccttagttttctcatctgtaaattgggaatagtaatagcatatatacataggtattatgtgtttctgcttgaacaagacttggctcacagtgtgaagtgttagtcgttgttttcattatcatcattaccatcaaccttatctttcttaaagttatgatctgagttcataaatcattcagtaaacctatttaggctgagcattgtaaatttaaatgcctgcaagggctggatgaacatttagtaagtaatgacagatcagactgggactttaagtgaactagggaattcattcccctccaagggagcagctgttaaagcagctttggcttacaattttttttttttttttttgagacagagtttcacttttgttgcccaggctggagtgcagtggcatgatcttggctcactgcaacctcaacctctgcctcccgggttcaagcaattctcctgcctcagcctcccaagtagctggaattacaggtgctctccaccacgcctggctaattttttgtatttttagtagagatagggtttcatcattttggccaggctggtgttgaactcctgacctcaggtgatccacccgcctcggcctcccaaagtgctgggattacaggtgtcagccaccacgcctggcgtgatttttttttttttttgagacagaatctcgctcttgttgccccagctggagtgcaatggcgcaatcttggcttaccataacctccgctttccgggttcaagcaattctcctgcctcagcctcccaagtagctgggtttacaggtgtgtgccaccacgcctggctaattttgtatttttagcagagacgaggtttctccatgttggtcaggctggtctggaacttccgacctcaggtgatccgcctgcctcggcctcccaaaatgctgagattacaggcgtgagccaccgcacctggccttttttttttttttttttaatggaggtaaaagtaagtatgtgaggttatgtatatgttatttagctcgatttagccattccacaacatgtacatattttaaaacatgttatgggctggtcatggtggctcatgccataatcccagcactttgagaggctaaggcaggaggatctcttgaggccaggagtttgagaccagcctggataacatagtgagaccccatctttattttatttcaataaataaataaaacctgttttacatgataaatatataccttttttgtcaattaaaataatttaaaaatactacttaaggtcttgggaatacactcacaatgtattggtagttaaaatttttttttttttttttttttttttttttttttttaccagttgctgtggctcacttctataatcccagcactttgggaggccaaggtgataggattgcttgagcctcggagtttgagaccagcttgagcaacatagcgagatcccgtcattatatttttcaaaattaaaaaggaaagttttcagaaggttaaaaaaaaaattgaggcaaaattcactactttaaagtgtacaattcagtgttggcttactattgaccttggggagagtgcagaccatgtgcagactgaacatcttaatttttttctaaggagaagctagaaatcaagattttgtaagaaatttttattgttaaatgttggcaacttatgaattcatagtgtaaacactgtgggccaaacaaattaccactgtgggcagaatttgtcttgtggcttgctgctttacaacctctgatctggggcttgactttctgcagcataacccatgttttctgccctctgagaagaaagttcttacccacgtaaagatttaaccagcctcggcagcatggtgaaacactgtctctacaaaaaagcctcataaaaatcagccaggcatgatggtggtgtgcgcctattgtcccagctgaagtgcaagggtcgcttaagcccaggaggttgagactgcagtgagctcatgtcgctgcactgatatcatgtcactgatatgtcactgcactctagtctgggcaacagagtgtgaccgtgtctcaaaaataaatacataaataaataaataaataaaacagttcaaacaatacctcaaagcagtctagtactgaatgagaggtatgtagaataattattaaggcagatagaaggagggaagttagttagttattcagaatatgccaaggtgcagaggcaggaatggacttcagggggtggagtttaattttagaggatttgtgtgagcctggtaataggcaaaagttttgaaaatttgagaagagtcaagcctcttattttgaataaccttgagacctattggctgataggattaaatggtattttgtgaagatttatttggcaaaattgaggtctgtagtatttactatggttggaggcagggagactaggctatggaggtgtcagtgggaatgaaaataaagggggaaaagcttgtataagagacaaaaggttgcattaaagagggccaattttgaaagctttttctctattgacttttgtacaaactgggatatgggaagatactgtgtacaggctatattcctcttttcatgttgtgaatcttgctttatcccttactcagtcccaacagtgtccttgttgatggattacatacgttttcttacgatttcccagcttgcacaagtagaatagaaagaaaaaccaggccaggcatggtggctcacacctgtaatcccagcactttgcgaggctgaggtgggcggatcacttgaggctggagtttgagaccagcctggccaacagggcgaaacctcgtgtctactaaaaatataaaaaattagccgggtgtggtgttacactcctgtagtcctagctacttgggaggctgaggcatgagtattgctggaaacagggaggcggaggttgcaatgagccgagattgaactgctgcactccagcctgggcgacagagcgagaccctgtctcaaaaagaaaaaaccaccaaagtagtgtaattgctcatcacatttcttgtttggggtttttggttatctcggttaacctctggtatatttcattagaccttagtttatacattgaattttcatatttaccaaggtttggaaacaatgacaaatggcttgctcttagaaagatgtagaattttcttgcagaaacttgagataactgatatggctgggcgcggtggcttacacctgtaatcccagcactttgagagtccaaggtgggcagatcgcttgagcccaggtattcaagaccagcctgggcaacatggagaaaccctgtctctacgaaaaacacaaaaaattagttgggcatggtggcgtgtgcacctgtagtcccagctacccaggaggctgaggtgggaggattacctggtcccgggaggtcaagactgcagtgatttacctgtgattgtatcacagtactccagcctaggcaacagagtgagaccctgtctcaaaaaaaaaaaaaaattatgattcagaatgtctgaagaaaccaataaatgtagaaaggtagaatatgttcagcataacctgagaaagtgatttttaggatgttattttctaaataagatttagattttgttctgtttatacttctcatgaaacttttttttttttttaacatacctgggaagttattcctcattcttggccaaatacaaaatgtcattattttagagactatagtctttttcgcaagtaagctgaatagtgtgttaggtatagtctgagtattaagaatatctgagatctgtattaaaaacagatgtaggccgggcacagtggctcacgcctgtaatcccagcactttgggaggccaaggcgggaggatcacctgaggtcaggagttcgagagcagcctggccaacatggtgaaaccccatttgtactaaaaataccaaaaaattagccgggtggggtggtggcgcacctataatcccagatactcggtgggctgaggctggagaattcctgaacccaggaggcagaggttgcagtgagcagagattgcgccattgtactccagcctgggcgatgagcgaaactctgtctcaaaaaaaaaaaaaaaaaaaaaaagatgtaaaaaaaaaaaaagaatatctgagatatagcaaagtttttctcatggatgaataaaaatactgaactgggcctttaaaaaagtacagaaaattgcctgtcatagaaatgcagcagtagggtcaaatgagctaaatctaaatctcatttaatgaaaaaggcactttccttttatttttgaaggatggtctaacctagtttttggaattcatttgttctgcaattaaaagagatttttaggtggttcatttaattatagctgttttggaaatgggaaggaaaataatgtgagagagagattaactgcatttgcttctgtggaaagtcagtagtcaaaaggagagtctggattatttatttatttatctaaaaatatggaacacttggtgaattttaaccttatctttgctcagaggatgtactaatctctgtgttctaattttttagtatatgtgctgctgaagcaaacacacagattatttttttctgttcttaagttttttggaggaaagctatttactataggtcttaattaaaaactatattctgtatatattgaaatgtgcagaaccctgctgctgctgtttttcgttacccagaatgttgcttacatctctctactatcatcttctctccctttgttttagcccttggggtttatgtttttttattcctttatttcatttttttctgaggttttggaagggaatggagaatggggtgtgttcattctgcctggctggttgattttatatagaaattgatgttttcatctctaagggacaaagaaaattaggaaaatatcctagttttatttttattgtggtaaaatacacattacatacagtttaccattttaaatattgttaagtcttcagttcagtgacattaagtacatttaccttgttatgtgaccattaccactatcggtctctagaactttttcatcatccagaactgaaacttgtacctattaaacaataattatccatttcacctcctccctgctctggtaactactattctgttttctgtctctgtgaatttagctattctaggcacctcatcgtaaaagtggagtcatacaatatttgtcctttttttttttttttttttagacggagtctcgctctgtcacccaggctggagtgcagtagtgcgatcttgactcactgcaacctccgcctcctgggttcaccccattctcctgcctcagcctcccaagtagctgggagtacaggcacccgccaccactcccggctaatttctttttgtgtttttagtagagacagggtttcactgtgttagccaggatggtctcaatctcctgacctcgtgatctgcctgccttggcctcccaaagtgctgggattacaggcgtgaaccactgcacccggcccccccccccctttttttttgagacagagtctcgctctgtcaccaagctggaatgcagtggtgcgatgttggctcactgcaacctccgcctcccaggttcaagcaattctcctgcctcagtctcccgagtagctggaactacaggtgtgtgccaccacgcccagctaatttttgtattttttaatagagacagggtttcaccatgttgaccaggatcgtctcaatctcttgaccttcctcagctgggattacagccgtgagccactgcgcctggccaatatttgtccttttgtgtctggtgtatttcacttagcataatgtcttcaggtttcatgttgtaccatatgtcagaattttattcctttttaaatgctgagtaatattccattttatatattttagtaattttttgaaggactgaataggctcaagtacagcaatgacatattttttgttcatttccctgttatcttttttgctgtgaactgtgattttaaatcatgaaattaacattgaactatgctagagatactagttttgggccacatcttctgttctgaccttaggtaatccactttgcttgggttgtttgtcttactcagttgtaagagtttattgtaaattctggatacaactcctttatcagatatgtgttttgcagattttatctcctagcctattgcttgtctttccattttcttaatgatgtcttttttttttttttttttttttgcaaaaatagagatggggtcttgcattgttgcccaggctggtcaaactcctgggctcaggtgattttcctgcctttgcctcctaaggtgctatgattacaggcatgagccaccggccctgcccaagaagttgagtgcaatcaaaattagaaactttgacccttttttaatttatttttgagacagagtctcactctgtcacccaggctggagtgcagtggcacaatcgtggctcactgtaatctccacctcccgggttcaggagattctcctgcctcagcctcctgagtagctgggattacacgtatgtgtcactgcacctgggtaatttttgtatttttagtggagatggagtttcaccatgttggccaggctggtcttgaactcctggtctcaagtaatctacctgcctcagcctttcgaagtgctgggattaccggtgtgagccactgcgcctgtttgaaatttcaactctttagaagacatcattaagtccaggcatggtggcttgcgcctgtaatcccagcagtttgggaagctgaggcgagaggatcgcttgagcccaggagttggagaccagcctggccaacaaagtctacaaaacgaaacaaaacaaaaaaacaactatctggacgtggtggtgtgtgcctgttttttttgtttgtttgttttttgagatggagtcttgttctgttgcccaggctggagtgtggtggcgcaatctcagctcactgcagcctccacctcccaggatcaagtgattctcctgctgggactacaggtgtgtgccaccatgcctggctaatttttttttttttgagatggagtcttgctttgtcgcccaggctggagtgcaatggcgcgatctctgctcaccgcaacctccgcctcctgggttcaagtgattctcctgcctcagactcccgggtagctgggactacaggcgcacgccaccatgcttggctaattttttgtttttttagtagagacggggtttcaccatgttggccagactggtctcaaactccttgcctcgtgatccgccctccttggcctcccaaagtgctgagattacagacgtgagcgaccgcgcctggcgtgtgtgcctgtatgtagtcccagctatttgggggagaatgaggcagtaggatcccttgagcccaggagttccaggctatagtgagccatgatcacaccactgtaccctagctctgtcaacagagcaagtccctgtctctaaaaaaaaaaaaaaaaatggaaagaaatactcaaaacactcaatttctcaattgttttctttaatgaataacgtgtttggtgtcatatctacaaaaatctttgccttactggacaatcagtaaatctttcttagatttccatttgtttacctgtgagaacaaataagatgtatgtggtattttgccttctttggaatagtatttctattctgtttctttttgaatttaatcggaggggctaatcttgggatagaatgctaaggtgaaaatctacagactcaaattggaatgtagaattgactttgctttcataatcctagttgtttcctaataggtaagtggtaatttggttcctctccccttcctagtattgagggctcttggatgtaaactcttatttgtgtcattttattctaggtttttgacacaatctgaataacaatgctttttggctccttttaaggaaaatgcatgaattttgttaataaagtgcatatacatattactcagtgactcagtattgactttcagtttacttgataattcttttttcttttcttgagatggagtctcgccttgtcacccaggctggagtgcagtggcgtgatctcagcatactgcaacctctgcctcctgggttcaagtgattctctgtctcagcctctcaagtggctggaattacaggcgcctgccaccatgcccagctaatttttttgtatttttagtagagatggggtttcaccatgttggccaggctggtcttgaactcctgaccacaagtgatccacctgccttggcctcccaaagtgctgggattataggtgtgagccaccacgctcagccaataattctttttattattactattattattattattattattattattattttgagacagagtcttgccttgtagctcaggctggagtgcactggcatgatctctgttcactgaaacctctgcctcctggcttcaagcaattctcctgccttagcctcctgagtagctgggattacaggcacgcaccgccacgcctggctaatttttgtatttttagtagaaacggagtttcaccatgttggtcaggctggtctcaaactcctgaccttgtgatccgcctgcctcggcctcccaaaatgctgatattacagccatgagccaccgcgcccagtccttttttaaattttttttcagacagggtcctactttgttgctcagccgggaatgcagtggcatgatcatggctcactatagtcttgacctctcgggctctggcgatgctcctgtgtcagtctcctgagtagctgggaccacaggtgcataccaccatgcctgggtagtttatttttattttttgtagagatagtgtcttgctatgttgcccaggctggtgttgaactcctggtctcaagcgaccctcctaccttgacctcccaaggtattgggggtgggattacaggcgtgagccaccatgccagtcttgggcttgatagatttttttttttttttttttttgagacagagttttgctcttgttgctcaggctggagtgcaatggtgcaatcttggctcactgcaacctccgcctccttggttcaagcaattctcctgcctcagcctctcgagtagctgggattacaggtatgcgccaccacgcccagctaattttgtattatcagtagagacagggtttctccatgttagtcaggctggtctcgaactcctgacctcaggtgatctgcctgcctcggcttcccaaagtgctgggattacaggcatgagccactgtcactgtgcctggctgatatatatatgtgtgtatttattattattttttttaatagaaatggggtttcactgggttggccaggttggtctcggaactcctaggctcaagagatcctctcaccttagcctcccaaagtaccaggattacaggcatgagccaccaggactggtctgtaattcttttttttttttttttttttttttgaggtggagttttcactcttgttgtctaggctggagtgcagtggcacaatcttggctcgtcgcaacctctgcctcctgggttcaagctattcttctgtctcagcctcccgagtatctgagattacaggcatgcaccactgcacccggctaattttgtatttatagtagagacgggatttattcatgttggtcaggctgctcttgaactcctgacctcaggtgatccacctgcctcagcctcccaaagtgtttttggattacaggcatgagccactgtgtccggcctcttttttttttttttttttttaagtcaagtgaagcagtgggagtggagaaggaacaaagaaatctgtaactggttgtgatcagttagttgtaaataccagtgcagcagttggaccagccgaggcctgtaattcttttttttttttttttttttgagatagagtcttgctctgtcgcccaggctggagtgcagtggcgtgatcttgtctcactgcaacctccgccttccggcttcaagcaattctcttcctcagcctcctgagtaactgggattacaggcatgcgccaccatgtccagctcatttttgtatttttagtagagacggggtttgaccatcttgggcaggctggtcttgaactcctgaccttgtgatccacccgcctcagcttcccaaagtgctcagattataggcttgagccgccgtgcccagctgcctgtaattctcaaataatgtttagaaatgatctgaggaaagtttgctggaaggatgaggcatggtggatattagggtcttttttttttttttttttttgagacggagtctcgctctgtcgcccaggctggagtgcagtggcatgtcctcagctcactgcaagctctgcctcccgggttcttgccattctcctgcctcagcctcccaagtacctgggactacaggcgcccgccaccacacctggctaattttttttgtatttttagtagaggcggggtttcaccgtgttagccaggttggtcttgatctcctgacctcgtgatccacctgcctcggcctcctaaaatgttgggattacaggcgtgagccaccgcacctggctattagggtcttatattttgagaatgtatagatatttagagatggtcagaaacaagaaaattttttttttttaagaccgagtctcactctgtcgctcaggttggagtgcagtggtgtgatctcagctcactgtaacctctgcctctgagattcaagccattctcctgcctcagcctaccgaggagctgggaccacagtaggcacatgccaccacgtccagctaattttatgtgtgtgtgtgtgtgtgtgtgtgtgtgtgtggttttttttttttttttttttagcagagatagggtgtcactatgttggccaggctggtctcgaactcctgaccttaggtgatccgctcaccttggccttgcaaagtgctgggattacaggcatgaagcatcacctctggccagaaacaaggattccttagagccaggaaattcaacattatatataattagatgtataatttcacacaagcattgtttgcaagagaacaatacttatagtagtacaacaatatttatatttattgtggcaaatgctttaaactctagcagtagtcaaagctagaaacaacttgtaataatagttaattttgaaatgtttgtcagaaagctgtttgtcagaaaggggaagagatcaccttctggaatattaggtacagagttcaaaccagcaaatgaatgctaaaagttagatcctggtgccaatttccttaaattctgtgttcatactgttgaacctcgaaagttgtagcttcctctttttctctttgaacagtataattgtccttttttgcatatgctttagaatccatactgatgtatttggttggaaagtgggaaaggagcttttagtgttctgagatcattgtgtgatgttcagaaccaaagtgtcactgttacatggtagagaatggttcatattctacctccttgttaagtcaattaagtcaatttttcctagtaaatgggaaagcaaccgccttccctatcatgaggggttttgggtttcttcccacttgctttgctgagaaattaaattatggaaatgggtatttaccctctgctccaatctaaataaacttttattccttctaccaataccttcagtagcccatgcaccaaagtcggctcctttgtttttttttttgttttgttttgtttttttgaggcagagtcttgatctctcgtccaggctgtagtgcagtggtgtgatctcagctcatggcagtctctgcctcctgggatcaagcaattctcagcttccaagtagctgggatcacaggtgcctgccaccacacctggctaaggtcctttgtgattattagcagagaatgggatctaaaaatgttcctgtgttccttctagctagtctttgctactgtgcccctagataatgggatctagtttttcacttgagtagtgtttttgggaacatgacagagtagccctgtccaagggagacatactactcggtatgtatttctaatttaccacacatgcttctgtattttatagtaagattgtttgagagtttgacttcattagggtttagttctctgaataccactatatactttagctctttgaactctggactttctgtcacaagcagtttttctccttagtttttttgtgtcttctgaaatgtcattttggtggattcttttaagaaaatatagggctatattaaattacttaaaggttttctaagtcacaatagatgtggcctgtaaaaatatctgattatgttgggtgtgttatttctgaaaataaaccaagcaaatttcacaatatcctgtttaataatttctctataaataagatacatatttaaaataaggctataaatgtttgttgcttaagagacaagatattactgaaattatcttctgaagtatgtctatccctttccacatttttgtttccactgccttttcagtaagatgttaaggttaattttacctctggcagtgttttagcaccttctttctatattgggcattctatctgtcacatttttctagtgtagtagtaaacattactcaaaataaatgatttataggccgggtgtgatggctcatgcctgtaatctcagcactttgggaggccgaggcgggcagatcacctgaggtcaggcattcgagaccagcctggccaacatggcaaaaccccatctctactaaagatacaaaaaaaattagccagatgtcatgcatgcctgtaatcccagctactagggaggctgaggcaggagaattgcttgaacccaggaagcagaggttgcagcgaggggagattgcgcccctgcactccagcctgggcgacacagtgaatgtctgtctcaaaaaaaaaaaaaaaaatttataaagtgctaagtattgacccagctgggcacagtggcttatccttgtaatcccagcactttgggaggccaaggcaggaggacgacttacttgagcccaggagttcgagactagcccgggcaatatagtgagaccctgtctctatctccctgtaaaaaattagatgggcctgtggtatgtggctgttagtctcagttactcaggaggctgaagcaggaggattgtttcagcccaggtggttgaggctgcagtgagctcgatcactctagcataggcaacagagcgagaccctgtctcaaaaaaaaaaaaaaagaccctgttttgagtttctttgtaactgacagactaataggtaatagagttttaaaatattgttactagatttttttttttcttttttgagatggagtctcgctctgtcacccagactggagtgtagtggtatgatcttagctcactgtaacctccgcctcctgggttcaagcggttctcttgcctcagcctcccaagtagctgggattacaggtacctgccatcatgcctggctgatttttgaatttttagtggagatagggtttcaccatgttggacaggatggtcttaatctcttgaccttgtgatccacccgcctcggcctcccaaagtgctgggattacaggcgtgagccacagcacccagccatgatttagattcaaactgtatcttcattggttccagtcacaatggtttacagtgctaagtaaagctatagattgcatactgctgtacttgtgaaggctttttttttttttttgagacacggtctcactgtgttgcccaggctggaatgcagaggtgcagtcacggttcactgctgcctcaacttcctgagttcaagcggtcctcccagtttggcctcccatgtagctgggactataggcatgcaccactgcatctggctaatttttaaattttttgtagagatgggagtctcactgtattgcccaggctggtcttctgaaggcttttagtttgtttgtttgcttgtttgtttttaaatcttgtttgcttgcttttcttttctttcttttctttttttttgagatgaggtcttgctctgtcgcccaagatggattgcagtggccttatcacagctcactgcagcctctacctgctggtctctggcgatctttgtgcctcagcctccccgttaactgggacaacaggcacataccaccacatccagctaatttatttttattttctgtagagacaggattttgctctcacatatctgtccaaccaataaacaaaaaagttatgatactcagggcaaagttttctctaactcctcaaaaggacttgaatttaggacatctttcttactgagacatacaaaggcttaaaagtatgtattacaatccaaaacactcaccactgtctaacatttctcctccaaatgagagcactaatagcctattcaaaagagtctctaattatgaatgtgaagttacaaagaatgtttttttgttcttaggtctatgaagataacacaaaggcaacaagtgaaaacacaatgcataaagtttcactttagtccccttataacagaaaacaagagatgaagataagagcacttttgctgtcctagaacttaaaatgaaaatctaagagagacccataatataaatacaatcatcccttggtatatgtggggattgcttctaggaccaccacatataaccacgtcagtgcatgctctgaagtacgccctgtggaacctgcgtatgtgaaaagtccttcccatagacttgggtttcacatcccatgagtactgtattttcaattggtgttttttatttttattttttattattttttaaaaaattttaattaaatagaaatgaagtctcactatgttgcccacactgctttcaaccttctgggctcaagcaaccctccctgctcagccttccaaagtactgggattacggacgtgagccactgctcctggcctcaatctgtgtgtggttgaaaaaaggctgcatataagtggatctgtgcagttcaaaccagttgttggacaagagccaactgtaattagaattataaaaattgatgccatgctctctgtgtgagtaacaatgcagtaagaatatgcagattttagtcactaattttgacttcctgggaaaggaactgcagactagatgctacaaaagagaaacacttgagggtgaaaaagattaactgtaagaaaatgggaaagagactaagaaatccagtttcttagaaaaacatattcagtagaaacttaggaacagaagtgatgtcttggttggccatgagatagtagatccctacaaccactagaaagtgtccattagggacattatccctttagggtaatgtgcaggtggtcatgtttcagactttattactcaaagtcatgaccactggggaggttagataagcatctttttaaggggttatctatgttacaggcattgtttaaagactctgctgaagaacaccttggtatgcaggaatcaaacattggtcagggccaggcactttgggaggccaaggtgggtggatcatttgaggtcaggagtttgagaccagcctggccagcatgatgaaaccccatctctactaaaaatacaaaaattagctaggtgtggttgtgggtgcctgtagtcccagctactggggaggctaaggcaggagagtcgcttgaacctgggaagtggaggttgcagtgagctaagactgtgccactgcactcagccagggcaacagagtgagactctgtctcaaaaaaaaaaagaaaaaaattggttagcatgatggtttcacttcaagatggcatcactcttgcatgcaacaggcagttttcctacaactgtctttaattctgcagatactctgtcagtctttaaaatgaaactataaattatagattatctacatttatggatgaagaaagtgtggcttagagaaattcagtaatttgctcaagttcacagagtaacagttcaggaatgttgatctagatctgtctgacttcacagttggcatacataattaccatgctataatgtcttctgtaatacatggtatagaattgacaagaataatctttttttttttttttttttttttttgagatgaagtctagctctattgcccaggctggagtgcaatggcacgatgttggttcactgcaatctcagccttccaggttcaacgatcctcccgcctcagcctcccaagtagctgggattacaagcgtgtaccaccatacctggctaatgtttgtatttttagtagagacgaggtttcactatgttggccaggctggtctcgaactcctgacctcaggtgatccacctaccttagcctcccaaagtgctgggattacaggcttgagccactgtgcccagcctagatttaatcttttttttttcttttttgagatggagttttgctcctgttgcccaggctggagtgcaatggcgcaatcttggcttactgcctcccgggttcaagcgattctcctgcctcagacttccgagtagctggaattacaagcatccaccaccacgcccagctaattttttgtatttttaatacagacggggtttcaacgtgttggccaggctggtgttgaactcctgacctcaggtgattcacccgtcttggcctcccagagtgctgggattacaggagtgagtcaccacgcccggcctagatttaatcattttaaccatgtatgcagttgtaaataatagaactaagaatctggcgctcaggggagaggatgggacttgaagtgtggattatctatttttttctactctgttttatgctgtttttaaaattgtacaagtcaacagtgatacatgtcctatttttagaacttcaaacaatacatacaaaactacagttccctatgaccacgtacttgagtacacaggtgccctcctcctgaatggaatgtatactttttctgcgtttatttacaagtatttgtacccataggaatatatagtgttttagtttgcaaaaataatatcatactgtacatactgatggggtgatcattttgtgatctaccccaccccaactcatgcatgttgttctgcagctttaaagatgttcttgggatctctcaatttcagtcattaataagttacttattttgatacctgcatagtaatctgttctgtggtatgaatatgtgatttaatatatgaatatgccaattgataatatacattatttctaatttttttgatattatacaaatagtgatttttattcttttcaagaatttaaaatgcttggtgaattttagttatgtaaaactagtatgtatatgtacataaattattgaaattactaggatgtttttggcagagcacctcacaattctaccataatgattctctgtaattatctggagagtcattgttcttaaaaatgtttgcagtctgtgctttcattaatcttttctacatgaagttaattttagtttttaaaatatacttaatttttgtagagatttaaaattttttgcaactttgtaattaatgttaatttatatttagaataatttatactgtactattagggcattttcttgcaataaattattagtggagatgagcgactgttgatggagatgagtacctttatcatgcagaatatcagcagccagatattggacttttctcactgccccttaatttacttttttaaatattgtcgttctatggcaatcaggcttttggatattgaggaggaagtaataactacataatgtgataatgatgtctttgaggacccttgtccataacaagccatttgaatcagaataatatcttgtgcaatatggtgttaaggcttttaggttacatctcatttctgaatgtattctggatgacttctattgactttatgatgtttacctttcatatttaaaataagagggttcttttagcagattttggttataaaacatctgaaatagtgtaatttaaataaacaaggtaaaggaaaaaaatatatgtattatgccaagaaaatgagctagtccttatggttgagacgaaattttagctttgagcatttttgtatgtaagcacagaatgaagtaggttggattttatagggttcatctcagtaggaattattgttctatttcatttttgcagaattgagaagccatcataattgttttatatttaaacttttaaacagaaacctaaatttgcataaaaactcaagacagcgtttacagtttcaaggcattttgtttgccttattgtatttgtgtacttcttccatagtgcctggcaaacagtaagtgccaagtacatttagtttgattttattttttattgtatcttatttcttcttttttgaggtagggtcttcctctgttgcccaggctggagtacagtggtgtgatcatagctcactgcagacttgacctcctggttggggagtggtggtgtgcaccagtggtcccagctactcaggaggctgaagcagaaggacccccccagcccgggaggcgctccagaacaccccagcttgggtgacagagtgagaatctttctcaaaaaataaataagtaaataaagttgcttgggacatgttatatagatgctatttaaagctatctggataggtaatatcctccagtttataatcatctgtaccccattgcgtgatggggtgatcattttgtgatccaccccaccccaactcatgcatgctaacagttatgtatgccttttctccaatttatctgcctgcgttttgtcagacgattttcagcgaaccttcactgggcaaaggggaagtcttcttttggcccctgtattactaacaagcattgacttctaaatgggtaatttggtcaggtgtggtggctcacgctgtaatccagcactttgggaagtcagggtgggaggatcacttgagcccaggagtttgaaaccagcctgggcaatatagtgagatcctgtctctaccaaaaattaaaaaaattaggcgagcatggtggcacccacttatagtcttacctactggggactgggtaatatcctcaagggaatgagtgtagatagaatagggaaccaagaactaagatctaggatatgttagcgttaagataatggagaaaaggaatcatcagaggatactgagaaggaacaatctgtgtggtaggacacaaacctggagaatatatcttgggaactgaagggaagaaagtaaaacatggaggaggggatgaacagccatgtcagattttgccaataagttaggtaggataaagactagaattgaaaattgtgtttagtaatgtaaaggcctttgttacatggtcttcagtaataaatagccaggttagcactatttatatatgtttttaatgggaatttttgatgtttacagtgtctcctttgccatgttcaggttttccaacctattggtggtatgtctgacagtggatcacaacttggttcaatgggtagcctcaccatgaaatcacagcttcagatcactggtaagttttagaaacatcggctgctttactttatttttccccgtatgattaaaaaataatcctgagagggccaggcatggtggcccatgcctgtaatcccagcactttgggaggctgaggtgggcgggtcacttgaggccaggagtttgagaccagccaagccaacatggagaatacaaaattagttgggcatggtggtgcacacctgctgtcccagctactccggaggctgaggcgtgagaatcacttgactttgggaggtagaggttgcagtgagctgagtttgcgccactgcaccccagcctgggtgatagggtgagactgtctcaaaaaaaaaaaaaaaaaaaaaaacttaagagaacaaaatatttaatggctgttacatgtcaggtgctcaattaatatttgctgaatgaatgaatgaagatatatagatatgtaatttttattgtagaatattcttggatattttacagtttttttttccttcaacatgggtacctgggtagttgctaattatgtttgtttggtattgtattaacagctttattgagatataattcatatcccctacaggttacccatttatttatttacttataacaatgacacaatcatgcagcctcctgctgtggtgactacagtcgtgcaccaccatgcccagcaaattctgcagttttttgtagagatggggtctcactataatgcccaggctggtttcgaacacctgggcttaaatgatcctcccactagggcctgacaaaaggcagataaataggagaaaaggcgtacatcttattagcatgcatgggtaggggtgggatggatcacagaatgattaccccatcatgcaatggggtacaaaatggttatatactcttcttcataggggaaagggagatggggaagtgtggatgattttagagggatggtaaatgatttttaggggaattcagagggctcgaagaatgtacaatggcctgggacaaagtctgtttggcccacagaatagatagtggtttatgacaaaagtctctccaggtccaggtctgttaaaagacttcagtcagccaggcacggtggctcacacctgtaatcctagcactttgggaggtcgaggtgggcagatcacctgagattaggagtttgagaccagcctggccaacatggtgaaaccccgtctctattaaaaataaaaaaaattagctgtgcgtggcggtgcacacctgtaatcccagctacttgggaggctgaggcaggagaatcacttgaacctaggaggcggaggttgcagtgagccgagatcatgccattgcactccagcctgggcgacagagcgagactccatctcaaaaaaaaaaaaaaaagacttcagtttttatattcctgctatacaagtttagttattgaaaactcagggatgggaacaaaggtaattgtaattgttttcttctttggtggatctggacttaggcagataagagaacttcagaaaacaacttcatgctgtactttgagagaaagaagattgagggaggggagctgcaggggtcagagagaccttgagagacttacttagttcagcaagtcaaagcaccatattttgggatatcagtttctgaaccccaaaagtacattcacagagttcagcaaccatcaccacaatcaactttaaaataatttcgtccttccaaaaagaagccctgtactcattagcagtcactctccatttaacccatccatccacaaacccaggcaactcctgatctttctgtctctagatttgcctattctggatctcgcatataaatggaattgtacagtgtgtggccttttgtgtcttctttgggcagactgttttcaaagttcatccatgttgtagcatgtatcattacttaattcctttttttgctaaataatattttattgtatgagtatacgaaattttaaaaatccattcttcagttgagggatgtttgggttgtttccactttttggattttatgaaaaatgctataaacatttgtgtacaagtttttgtgagaatgtatgttttcagttttcttgggtatatacctaagagtgaaattcctaggttatatggaatccatgtttattagcattttgaggaattccaaattattattattattatttttttttttttttggagacagagttttgctttgttgcctaggttggagtgcagtggtgtgatctcggctcactgcaacctccgcctcccgggttcaagtgattctcatgcctcagtcttctgagtagctgggactaccggcacgcacaaccatgtgtagctaatttttgtatttttagtaaagacggggtttcaccatgttggccaggctggtctcgaactcctgacctcaggtgatccacctgcctcggcctaccaatgtgctgggattacaggcgtgagccactgcacgggcccaaattatttttaaaagcagctgcaccgttttgcattcccactagcaatatatgaggattccgatttctctacattcttgccagtgattatcttttttatgatagccattctagtgggtgtgaagtagtattttactctgtgtgtgtgcgcgcgtgcatatgttttatccatttaatttttttttttttgagaccaggtgacagtctgctctgtcacccaggctggagtgtagtggtgcagtcatggctgactgcaatctctaacttctaggctgaagtgatcgtgccacctcagccttctgagtagctgggactacaggcatgcaccaccctacccagctccctattgtggttttggcttgtactcctttgatggctaatgatattgtcttttcatgtgcttattggtcatttttgtatcttttttggagaaatgtctgttcacgtcctttgtttgctattgtaaattaatacctctgtcgctattgttaattaatatctctgtctttatttcttcctctaatcatttcatgtatcactttcagattaatgtttttaatatgccatccaatatgtttcattcctgctcaaaaaccttaggtacttctcttagactatggtatagagtttctttagtatgagctaagacccttcaccctctgtctacatatggtgtctttgtaggttttttgtttttttttgtttgtttttttgagacagagtctctgtcgcccaggctggagtgcagtggtgcaatcttggctcactgcaacctccgcctcccaggttcaagcagttctctgcctcagcctcccaagtagctggggttataggcgcccgccaccaagcctggctaatttttgcatttttaatagagacgaggtttcaccatcttgaccaggctggccttgaactcctgacctcaggatccacccacctcggcctcccaaagtacagggattacaggcgtgagccaccgcgtccggcctgtaagtctttatatgtgaaccatttgtactagctagaatgagtcactggattttcctcagatgtgtatgtatttctatcacacaatgaaaacctcagtctctctccctttaatttgatagcatttattgattatagaacaattatcatcccctgtattttagtttcaactatgcctggcttatagcttcttctggattatgaataggttaggtcacagatcatatcttagcattattattttcctcaaaacctaaaggtgattgaatataaaaataatactgtcttaaggtaaccacatcatagaattttttcggatttccttcactaactctggtatctttccttagcagtatctgtttcttaaagaaagatattactatttcttagttaaggccagattccagttttttttccccacccctcatcctcaatctagcttgagtagctgacttatatcagaccagaattcttatgacttctttttggcagcttaaagttgaaagcttttattagaacagtcctttaaaacattctgtactttttcagattacataagtaatatacattttattttttactgatttaaaaaaatagtaaattattctcagagacaatgattaatagtttttttctttgcataaagtgtcttacttgctatcatcgttattgaattttttttttttttttactgtgatgataaacactaattgcacctcaaaaagtcgtaatccatagccatctcagatttttttctttttgagatggggtctcaccctgtcgtccaggctggtgtgcagcagcgtgatcatggctcactgcaaccttgatctcctggggtcaggtgagcctcccacctcagcctcctgagtagctggaactacaagtgtgcgccaccacacccggctaatttttgtattttttatagagatggcgttttgctctgttgcccaggctggtctcaaactcctgggctcaggtgatccacccacctcagcctcctaaattgcttgtattagaggtgtgagccacctcactcagccacatctcagatttttaaaatcttgggtctaaaatattctttttctttttttttttgagacagtttccctttcgttgcccaggctggagtgcaatggcgtgatctcggctcaccgcaacctccgcttcccagattcaagcaattctcctgcctcagcctcccagatagctgggattacaggcacccgccactatgcctggctaatttttgtatttttagtaaaaacgggttttcaccatgttggtcaggctggtcttgaactcctgacctcaggtgatccacccgcctctgcctcccaaagtgctgggattacagcgtgagccaccgcgcctggccttaaatattctcttttttataaatttttttctttttctttttttaattcattgcttgctaattgggtctaaatattctgagaatgctcaagtgtagggcaaaaaacaaacacaccatgaataatggataatagttcagcaaacattattagatatgaaacagagaacataagataaaagacagaagtgccaagtttaatagaatcaaatgcccttcataattcattgagttacttctttagttttgatgctagaatgcttagaactaagtattttgcacaaatctccttaatgacatcgtgggttttaatctcttaatgggtcagttatagtatttgttttattgtaagctgcctcaatgcctttctagaatcaagtaaggaataaatatgcaagtgtaaaaaatgaatgtcaggctgggcgtggtggctctcacctgtaatcccagcactttgggaggccgaggtgggcggatcacttgaggttgggagttcgagaccagcctgagcaacatggagaaactctgtctctagtaaaaatacaaaattagccgggcatggtggcacatgcctgtaattccagctactcggggggctgaggcaggagaattgcttgaacccgggaggcggagatggcggtgagctgagatcgtgccattacactccaatctgggcaacaacagtgaaactgtctcaaaaaaataaataaataaaataaaaataaacaaatgtcaccatgtattgtaatggcaagaagggataactggtcaggaaaaagagatcagtatttgactagagtcactgggaaagaaggtggtgtttggattgctgctatttatttatttattttaagggacagggttggccgggcatggtggctcatgcctgtaatcccagcactttgggaggctgaggcgggcagatcatccgaggtcaggagttcaggatagcctggccaacatggtgaaaccctgtttctactaaaaaatacaaaaattagccaggtgtggtcatacgtgcctgtaatcccagctactcgggaggctgaggcaggagaatcacttgaacctgggagacagaggttgcagtaagccaagatcgcacccctacactccagtggcacagtcacggttcactgcagccttaacctcctgggctgaagcaatcctctctcctcatcctctatagtggctgggactacaggcgtgtaccacccaccacacttgactaattaaaaaaaattgtgtttttgttttttttttaagacggagtctcgctctgttgccaggctggagtgtggtggcgtgatcttggctcactgcaacctctgactccctggttcaagcaatttttctgcgtcagcctcctgagtagctgggattacagacatgcgccaccaagcccagctgatttttgtatttttagtagagatggaattttatcatgttggccaagatggtcttgatctcctgaccttgtgatctgcccacctcagcctcccaaagtgctggaattataggcgtgagccactgcgcccggccaaaaatttttttttgtagaaacaaggtcttgctatgttgcccaggatggtcttgaactcctggcctcaagtgatgctcccagcctttccataagtgttggaattataggcctgagccactttccctgacctaggattgctgctgtttaaatgcagaaaagtagaaaaggaccctttgaggagacagcatgagcaagacacatgaaagaagagagtacacaaaacttgccctaatacccatgaaagctcctataataggggagccctgagaatgggaatggctgtgtctttcaggtgtgccttaaaaaaaatttattgctaagggagatggagatgggaagtaatcagtgtttgtatcaaagggtggttagatttgtgttttagaaagttagaaagagaaaaaaatttttctttttttttttttttttttgagacagtttcgttctgtcgcccaggctggagtgcagtggcgcgatctcagttgactgcaatctctgcctaccatgcccacccccttacctacttatttatttatttattgaaacagagtctcgctctgtcacccaggctggagtgcagtgacttgatcttggctcactgcaacctccgcctcccaggttcaagcaattctcatgcctcagcctccccagtagctggtattgcaggcatgcaccactgtgcctggctcactttttgtatttttagtagagatgaggctttaccatgttgtccaggctggtctcaaaatcctgacctcaagtgattcacccacctcggcctcccaaagttctcgaattacaggcgtgagccattgttcccagccaatttttaaattttttataaagacacattctcattgtgttgcccaggctggtcttggatgttttgaatcagctcttcgtttcttcttatcatttagccagggtctttaccttggatgtaagtctgttttcttatgtccttccctgtctttatttacctgtttcccatttaattatgcctatatataacctcagctattatactgaactcatctgtgtcttctttttttcttttttttgaccgggaaatttttttttaaattacaagctcaacccatttgttctgtttcaaaggtgcagtacttttcttcatttattagtgaaagaagttaagaaattaactttccaaaaaaatcagcaaatggcaagcaaatgtccttgaaagtcacagtcacatatagtgtctcctagaaaagaggaggggtaagacagcttccacctactttcacaagtttcatcaaatactggatctactcaagggtggagtaaaaaggcaactaactttctaaaaggagtatgttattaaatgaggcatttactatactccttcctaaaagccccagatggggaacatgttttctcaactagacctaggaagtagactgtggaatcaatcggtcctcctcaccttaagggccatccactggttaatgaattaaaaaaaaaaaaaagactgaaaaacaaacctcccccctaaaaaagaggagggggaaaaaaaaccactaagatgtcccagagtggaatcagggagcagcttcaacaattccaattagtctgttacagagtcatccacaagcatgccttgctttaaaaatacatatatatatcttgaaataacaaaactgaaactagtactaatcacttttctgacaatatacaattactcaaaattaactagtactgggctagggatacgggggggcggcgcatagctatgggccttgtctcacatgagtacatgtgggtaggtgcagtgcgtttgtcattatggcaaaaacgaattttaatttttaagctttagtttgacttaaacattgcttttagtatgatgccaacaccagctatgcagaaagggctctggagagatgttcctagcagcacacatatgcagctcttcttcggttctggaggttccagggcagccaatattgcttcgtcaaatacattctttaggcctttctttgtgagtgcagaacactccacgtacttgacagtcttcaggtcatgggccagcttattcagcagtctctggagtgataggcttctgtttgttcttggcaagtttctcaatagtagaggggtcatctttgagatcaatttgggtcccaacaagcaacaaaggagtctttggacagtggcacccacttttctttcacattttcaaatgaaaatggagagatggagagaccactgaaaaatagactagaaatacatctgtttgtggataactcagcagtcataatccctcataatcctcttgctctgcagtatcaaaaagtccaagagtatatggttctctaccagtcataattgttattgcatagttgtcaaaaacagttggtacatattctgatggaaatttgttgtgttgttttaccaacagcaccatcacccacaacaacacacttaattgtctgcattgctgaaatagttttgtatccactttaaatatttcaaatctcatgttgacctcagcttctccaccgggttgttggctcatctgtgttttttatttgatgtttgttgtatgctagcattgggcaaaataaggaaactttggtatttgccagaaatttcttatattctcgtctttactccaaattaagaaagagatgtcatcttgattttagttattattaatcgtaattaaatattactgcatttcccaaatttattacagtgcaatatatttagctctgattgttcagggaccaaaaagatcccttatacttatgttttttttttattcctttaacagtccagcaaactaagaattttatacttgtgatttagagtttagttctccacaggcagggcagagttcttccaaagaggtagctgttgctcaactggattgatctcttacctggttcattattctgcttatttatttagttttggcactgttttttgttgtaccttgttctctgtagcttatccaaagtaggttggataagctacggatccattctttttttgtatgtgtattgtaaaatgtttatgttgtatcagagagatacactgaagaactgaaatcagttcaaagcactgaccttcagaacagaaggatcagaggaacattagtttaagccatgaaaactatttgcattagtatgtgggtatgtgtgagagagagagagcacatgcatgggagagtgagatagccagcaagtgattataataaagcagagagacagagactagaaagcagggaaacttttgttttctaccatgactaataacaatttggttcaacatgtatattaaatacctctcagattaaatcccagagtgctccagaaattgtaaagattggctatatctgtgcaatcaagaggctcacggggtgagttaaatgagtaaaaactagtaagacaaaatgaaaagctgacggagccatacgtaaatatggaaatactctggaagcatggaggtggaaataatttaacttcttaggattaaagaagcctttaatcaaagagaagggggatgtttatctctcaggaaatataattttaatgggtataaaagaaaaaaggatcattctcagtagagggagcagcatgtttagaggaatgaaagtacatggcccatgtgaggaacagcaaataactaagggtggctagaatatagaactttggtaagatttgttttagtaggaggctggaagggtaagttatagctgcatactaagcaaggtaaaatgccccataagagtttaaacttcatttttcaggcaataaagaatcatttaagtaatgacattaatgacatgatcacatctattctaggaaaataattctggtggctgtgaggggttggattggagaagtgagagtaaaaacagttgtttagaggcctctcatagtagcccaggtgtcagatgagactgacatttttctggtcctttttcttccggtttataatgtatagttttttatttttttgtttaatttactgtgggactttagttttcagaaagtagtacattgatttattttatatttgtaatattatgactataacacaaggttttgttcaatctagactttgagatttgaatactgaaataatttctcctgtccaggttttgcagtgtgacccttgggcaaatttttaaatttcacagagcttctgtctttttttttttttttttttttgagatggagtttcacccttgtcacccaggctggagtgcaatggcatgatctcagctcactacaacctctgcctcccgggttgcagtgattctcctgcctcagcctcctgagtagctgggattacaggcgcctgccaccatgtctggctaatttttgtatttttagtagagacagggtttcaccatgtttgtcaagctggctcctgacccccgttgatccttttgactgagacttccaaagtgctgggattacaggtgtgagccaccacgttcggccgcttctctttttatgtgtaaaaattaggacagtaatacctgtttcgcagaataggtattgatattgaaatgacatttacgtgcaggcacatggtaaatactaaaattggtgctcctccacccccatgtaaagtttgttaggccaggcctggtggctcatgcctgtaattccaccactttggtaggcctaggtaagtggatctcttgagcccaggagtacaagaccaacttgggcaacatgtcaaaagcttgtctctaccagaaaaaaaatacaaaaatttcctggatgtggtggcacgcacctgtagtcccagccacttgggaggctgagatgggaggatggcttgagcccaggaggtagaggtggttgcagtgacctgagattgtgccactattctccagcctgggtgacagaaccagaccctgtctcaaaaaaaaaaaaaaaaaaaaaaaggtttcagtggggtttggtaggattatgtagcaaaattgctttcacaaatttgaatccagctgggcacagtggctcacgcctgtaattccaacactttgaggggccgaggcaagtggatcacctgaggtcaggagtttgacaccagcctgaccaacatggtgaaaccccgtttctactaaaaatacaaacattagctgggtgtggcggcgcgtgcctataaccccagctgcttgggaggctgaggcaggagaatcgcttgaacccggcaggcggaggttgcaatgagctaagattgtgccattgcactctagcctgggcaacaagagcgaaactcctatctcaaaaaaaaaaaaaagtttgaatcctagaaagccccaacaggggcagatcatttccttcctgtcagccttgcgttgctctttgttctaggtttaatcagtttcagagtgccacaagaggccctgaaatataatgagtgtatgtataattgtttgggctatttcaccttttcttagaccagaaatgtattaaaagtagaaattttatgtttttctgtgtaatcctgtgattaaatttggctctatattaagcactagagctttgatttaatagtactttttttttattttttattttttaatagagatgaggtctcactgtgttgtccaggctggtcttaaactcctgggctcaagtgatcctcccgcctgggtctcccaaagtgctggtattacgtgcccggcctattacattttaatcagagatagctctggtccccacttgaatattttttattctgaaaaagactttctatttcatgtttccacttagatgtctcagcatctggcatctgaaacaatttttttttttttttaaaagacagttttgctctgttgcccaggctggattgcagtggtgcaatcacagctcactgcagccttgacctcccaggcttaagcgatcctcctgcctcagcctccccccagcagctgggactacaggtgcacgccatcatgcctggctaatttttaaaattatcttttgtagagacgggggtctcactatgttgaccaggctttgttcaaactcctgggcctcaagtgatcttcctgcctcagcctcccaaagtgctgggattacaagtgtgaaccaccatgcttgatcttgtctatttgtctagccttctcttgcaactcttctttttcttcagtcagtcattctgtggctagcttgaatgccagcaaaaaggcacataagcctaaaaggatggaagtatttgatatatgtaaagtcagagtttcagggccaccacctgggactatgcctgcttagatatccagactttggactatatattaagctgctgcttcttttttttttttttttcgagatggagtcttgctctgtcacccaggctggagtgcagtggcgcaatcgcggctcactgcaatctccgcctcccaggttcacaccattctcctgcctcagcctcccgagtagctgggactacaggcgctcgccaccacgcccggctaattttttgtatttttagtagagacagggtttcaccatgttagccaggatggtctcgatctcctgacctcgtgatccgcccgtctcagtctcccaaagtgctgggattacaggcgtgagccaccgcacccggctatattaagcttcttaagtagttactatataaactcctctgacaactccaagggttccttaactttgatgagcattagcattctctgaactttgctgctacagtagataacctgggtggtggagtagataacctgggtggtgggtacttccttggttgtagttacctcatctatgagggagcaatgacttgccacctatggaaatcatggggtgctttgctagatttctacttgttataccctgtaaggggcctggacaaagctattttatggcaaaggtaactaaaaggtgaaggctaaggagtttgtatctcaagatgcacaacataggaagctcttccttagataatatgagatgttaaaaaaaaaatcttagtttgtagttcttattcttccattggctttccaacacacagaataaaatctaaattatcattattattattatttttgatacgtaggctcactctgtcgcccaggctggagtgcagtggcataatctcggctcactgcaacctccacctcccgggttcaagcaattctcctgcctcagcctcctgagtagctgggattacaggcgcctgccaccacacctggctaagttttgaaattttttagtagagacgaggtttcgccatgttggccaggctggtcttaaactcatgacctcaggtgatccacccgcctcagtctcccaaagtgctgggattacagatgtgagccgctgcgcccagctgcagattctttatcttggtttataaagctcccatacaaagcttatctcccttcatttaccattccttcctgtgcttgctatactttccctcagatatgccatactcatttgcctctctctggaatgctgtcttattcccacctccagtcttcccatggctggctccttgtcatttggatggttgcttaaaagtcttctcaaaggccttccttactaccaagtcattttctgtcacatcagcctgtttttcatcataaatactttaattagaatataatctccttgaaagccagatccttttctttactgttaattgctttagggacagagtttagagcagtatctgacacatggtaggcattcagatgtttgttgaccatgtttgtcaatgcatacattttgttttgagatatggtctcgctgtgctgcccaggcaggtcttaaacacctaggctcaagcagtcctcctgcctcagccacctgagtagctgagattacgggtgcaagccaccctgcccagccatatgtgtactttttaaatttttcctcctgttgcccaagctgttgcacaaccatagctcactgaagccttgacctcctggactcaagcgattctcctacctcagcctcccaggtagctgggactggcacacgccactgtgcccagctaatttttttgatttttaggcgagatgaggtctcgctatgttttccagattggtcttcgactactgagcttaggcaatcctcttgcctcagcctcccaaagttctgggattagaggtgtaacccgctgcacctggcccatatgtgtactttttaattgatctgagttctggacttttgataccatggaattctactgatgggaatttgggttgatggtacggggaacctctatatttatttactaggatgggaggaagtacaaaggttatgagtgaataaaattggtaagtattttagagcaaaactgcttctctgagtaaatttagtaaatctgcctaattatgaagttaaattgatttcatgagtgaattaacatctcaactattgaaatgtttttcatttcttttacatagtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagtgtaagcttggaagtatttttctgtagtatgttttgtttagtagatgattggaaatacaatttaaaaaaatgtttctcactttggttttttgttgttgttgttcctcctttctctcttctttttttttttttctttttcctaggactccttctggtttgcttttttgtttctctttagatagctgtttttatagtcactccctttctttaccttctctagtttagttggtgatgatattgctcttgtcactgaacaatagctgaagagagcccatggtcacggacctaaaaagatttctggcagcactttttattaactttgggttgaattaagggattatgagtactccccccccccccggtttttaacttaatttttaaaaatagtgttttagttagttttttctttgttttattttgagatagagcctcaccctgtcacccaagctggagtatagtggcactatcatagctcacagcagccttgaactcctggcctcaagagatcctcctgcctcagcctcccaagtagctgggaccacaggcatgcatcactgtgcctggccagttttttagtattttaaattacggtgccagttatactatagttatttattttttgaatgagatggggtcttgctatgttgtccagagtgctctctctcaaccttcccggctcaagcagtcttcccatctcagcctttttctcaagtagctaggactactactatacattttattctacaactttctttttgtacttaacactaatatcatggtgatctctttacctgagtacatatggatcttgcatcccttatatagctttgtaatattccttaatatgggtggactatattttaatagttctgtattgattctaatgttgcgctattaggcagtattgcagatacatccatgtgcatatatctttgtatgttggtgtttatatctgtagtgtagattcatagaagtaggatatagctcagttttaacacaaagccctaaatgttggcattataatctaagatattgacagccattgaaggttaattttaatttttaaaattaaaatagaagaaaacacatggagccaggtgtggtggctcacacctgtaatctcaactctttgggagactgagccaggaggattgtgtgaggccaggagttcaaaggtgcagtttgatatgattgctcctgtgaattgctactgaactctagcctgggcaatgtagcgagaccctgtctctacaaaaagacaaacaaaaaaaaaaaagaagaaaaagaatgatttggccaggcatggtggctcactcctgtaatcccagcagtttgggaggccaaggtaggaggatcacctgaggtcaggagttcgagaccagcctgaccaacgtggtgaaaccccatctctactaaaaatacaaaaattagctgggtgtggtggtgggtgcctgtaatcccagctactcgggaggctgagacaggagaattggttgaacctggtaggcggaggttgcaggttgcagtgaactgagatcgtgccattgcgttccagccagggtgacaagtgaaactctgtctcaaaaaagagagaaaaaaaaaaaagaatttatggaagatcatcttgaggcccgtatcattcggatgttcctcatctgtgtttatttcaacataaatgtttcttaggctttctgtttttaattaatggctcattgtagattgagtcaaaatgaaacaatgtattaaaaaaatttcaagaaaacacatgaggctgggaatgactgcacatgtttgcaatcccagctacttgggaggataaggggggaggataaggtgctttagcccaggaggagttcgagattaaccagggcaaagtagcgagttcccatctcatatatattttttcctttaccaagtggtatctataaaaggtcgcagcctccatgattaccagagatgttcagttgaattagatggtcacctaatttcctccaactgctttgagtgcgtacttgatatgcacttggaggctcttaagctgttaatgtcatgaacttcttagtgatttaaaagttaagaaaaaaactctctttgtagttctatgtggtagtgctgttcttgattacaaacatttgggaaacttacaattcaagttattttcctgaatttttaagttgcagcaaattggcctggaattttatcacttcccattgtcgtgtagcaggctttccagactgcttttgagaattgaattgaaacaagactgatcatctttgacagtatactttatgtacctttcttccatattaaaaatagtaaagttaaatttatttgccttttatttcatccctattatgatttctaaattgactaatagagaatttcttttttccactctcacccaggctggagtgcagtggcgcgatctctgctcactgcaacctccacctcccgggttcaagcaagtctcatgcctcagcctcctgagtagctgggattacaggcatgcaccaccactctcaactaatttttttgtaattttagtagagacggggtttcaccatgttggccaggctggtctcaagctcctgacctcaaataatcctcccacctcggcctcccaaagtgctgggattacaggcgtgagccattgcgcctggccgagaaatattttcctaatacaatatataatatgagctctcttgaaagtagcatctgagaattttgaaaagaatgaatacattgtatcccctaagaagaggagcagtgtggaatttttagtttgttttatctacccattgccgttgaaatggtgctggttaataggtacaggtagacttcaaaggaggaaagtgtttctttgtcccctcaaacttgatcacattagagagaatgagatatagagaaattcaaacatttctggaatttgtctttatatcattgaaccataggactgtggtagattatatagtgctcctagctttctgatccttgactctaacattgattctacgtgtattgcaaattcaaatttcccagtttactttggaaataccattatagagagtattccttattggcatttagcaaggaatgagtgagtctatatttgatagttggactgggcaacttgcctctagcagtgtgaaacttgatgtatgtaatgtaatcttcaaatcatgtagctgacgtgaggaactttttaatataaagtttaatgtcaggattttattcacattacagttctgctacttactggctatttgaccttaggcaatttgctttatctctgaatgtcagtttctgtatctgaagaaggaagtgataattcccatctcatagggttactataaagataaaataacttcaagctctgtaaactactgacataaggatttaatttgtaaagttactcttctgtactactaaagtaaaactagttttccaatagtttgttgcaggataagcagttttacttttgttgacaatatgtgtatgaatttacttctgtagttcaactgcaagtgaaaatgaccatgtaagcatgtagcattcagataattttcataagattactgaacataggccaatattgattgtatagtaaactgtaaggggtgcagtgagaagactttagactttaaaactgaattgtaatttatttaggatctcattgtgatattcaataaaaataatattttttccctcttttttcacttttagtatcgttacccctgtgagtaaattacattttcgtgtgtggagtcaccagacactgaaatctgatgttttgttgggaactgctgcattagatatttatgaaacattaaagtcaaacaatatgaaacgtatgtatgtaagactaatagaaattgcacttagctgtttgtttttctggaagaaatttatatgtcaaacatgcataatgactcatgttctctcatacttttaagttttacttggttataggatgaacagatagaagaattttacactattgaaagtattctgagtaaccttggtttgaccattcattttggattcagtatttttagtaaatatttatttacttagtaaatagatattagtaaagtaatacatatttaattgtggaaaaactaaaatatagagcagagatgaaagaaaaaaataaaaatcccacttcagagacaaatcaaatgaatatttttacagatttccttttcagatgcttttttttttgggagggacatggggagacaaggactcactctgttttccaggctggagtacagtggctatttacaggtgcagttgcagcacagtgtagttttgaactcctggcctcaagtgattatcctgcctcagcctcctgatatatctgggactataggcaggtaccaccacatccagctttaaatgcttatttttaaaaatgtcctcattttatgaggttgtggttttatttgtatatgtatatttatataatgtagaaatatgtgtagcttgttttaattaatatatcattttaaaacacatttttttctacccctcgactatctaaaacatacttctaaaaattttctcatttaggacttattagatataatttatccttaaattatgtttttactcaatttaattcaggtatatattactaaataatccttattcttatgctagcccattttatactatagtcttacaaggatggaatgaacataataaacgatggagatactattttacatcatgaatatgaaacattagcatattttgtcctttttaaaagatacagtgttttggtgtcaaaagtgttcaaaccttgggtgaaacatagttaaacagtttatatgcacatatagttatattttctcggacatcacatttttaacagttaatttttaacagttaagatgccttaactgggaaaaaagtgaccattttttctgtaactttattttcttccagttgaagaagtagttgtgactttgcagcttggaggtgacaaagagccaacagagacaataggagacttgtcaatttgtcttgatgggctacagttagagtctgaagttgttaccaatggtgaaactacatgttcagaaagtaagtgactacctttttaaggtctttaatgattcttcttaaataaaatagccattgtagtatgctgtatgtaattattttgattttttttttcagattaataaaatgtttttttctggccggtgtggtggctcacgcctctaatcccagcactttgggaggctgaggcagaaagattgcttgagcttggaggttgaggctgctctgagccgtaatcacatcactgcggtccagcctaggtgacagagtgagaccttgtttctttaaaaaaaaaaaaaaagaaatgatttttttctttttaaaaaatagacattgatcactttaaacattttctttttagtgtattatttctgtgaataaaagcatgtatatttttacataagttgaaaaattagccaaatagaagttgaatcacatttgcctccatgagtaatgagttgatttatatagtatttattctgtaggccaactatggcagttaatatgggttagatgccacaccgccaactgtgccaatggcagacagagtttattgtctgtagcagtgtggggctgagtttaaatatgactttaaatccttttttttttttttttttttttttttaagacggagttttgctcttgttatccaggctggagtgcaatggcacgatttcggctcaccgcaacctctgcctcctgggttcaagcgattttcctgtctcagtctcctaagtagctgggattacaggcatgcgccaccacgcccagctaattttgtggggtttttttgtttgttttagtagagatggggtttttccatgttggtcaggctagtctcgaactcttgacctcaggtgatccgcccacctcagccttccaaagtgctgggattacaggcgtgagccactgcatccggcctctaaatccttcttaacactgtaccacccagccattacaagctgagatccatttaccattccccttctacttctgtaggctacacttacagagatatcttttgacaatactaattcattatatgtgtgttagtaaatcttacaatctctgatttactagtgtgtgttaaaggaaaataaactgtggtggcacctgagttagtggctacacagctagcatatttaatagaactttttcctactgttttcccatcagatatttccatcacttcctaatgtgttaagtgtattttcacttgaaacatagattttagaggcctgaagacaatgaaagagcagattaatggatttcttgatgagtttgacgaagatcttttggtttacttaggaactgcattatgaaacattttgcagctgtcaggtgctattctttttctactttgttgaaagacttcctacttcctctttgactcatgacttttaaaaatagcaggacaggctgggcacagtggctcacaccccttgatcccagcactttgggaggctgaggcaggagggttacttgagcccaggagttcgagaccagcctaggcaacataacaaaaccccatctttgcaaaaaataaaaaaatttgccatgtgtgtggcacgtgcctgtagtccaggtacttgggaggctgaggtgggaggatcacttgagcccaggagtcagaggttgcagtgagcgaagatcacaccactgcacttccagcctgggtgacagagtgagactctctctcaaaaaaaataaagtagcaggacctaatatgtcttccagattagttctctggggctagtgaggatggaaagaaatttctgaaatggttatactgatttggagttgacactttgattattgttcacaagaactctataatagtcacatttttctatacataaattggaagtctggaagataaaatacaagttacattgttaaactgccctaaacctcagtatttatagtgtcctaagcttcgcccatagaagatgaaactattactaatgtaaaatatttaataattgctggacgcggtggctcacgcctgtaatcccagcactttgggaggccgaggtgggctgatcacgaggtcaggagtttgagaccagcctggccaacatggtgaaaccccgtctctactaaaaatataaaaattagcctggcctggtggcgagcacccgtaagcccagctgctcgagaggctgaggcaggagaatctcttgaaaccagaaggtggaggttgcagtgagccaagatagtgccactgcactctatcctgggtgacagagcgagactctggccaggcgtggtggctcacgcctgtaatcccagcactctgggaggccgaggcaggcggatcacctaaggttgggagtttgagaccagcctgaccaacatggagaaacctcgtctctactaaaaatacaaaattagctgggcgtggtggcgcatgcctgtaatcccagctactcgggaggctgaggcaggagaatcacttgaacccgggagttagaggttgtggtaagctgagatcatgccattgcactccagcctgggcaacaagagcgaaactgggtctcaaaagaaagaaaagaaaacagttataacaatatactacaataaaagttttatgaatgtcatctctcagtttcactttcactccaaaaatacctcatttttttagctttgtttggacctttggggggaaaaataccttattgtactcacctacttttggaccacagttgactgtgggtaattaaaaccatagctaaggggaggcctactgtacttacagacacatttttggttctttctttttggtggataaattttctaaaaatggcagttatataaataaactttttccaagtgaaacaaagtgtacttgttttttctttttctttaagttgtattttaaaactagctggctttatattcccctactttcaactagtttaatatctcgctacaagtctcggttataatgttttctttacataatttgttatggtgttttccttcaatgaagtacagagttaatctgctttcatgagtctctaggaagaggtcttcctagacctcttcctagctttttttttttttttgagacggagtcttgctcttgtcacccaggctggagtgcagtggcactatctcagctcactgcaacctctgcctcctgggttcaagcgattctcctgcctcagcctccagagtagctaggattacaggcatctgccaccacacctggctaattttaatttgctatttaggtagacttttttttttttttagatggggtttcgctctgtttgcccaggctggagtgcaatagtgcgatctcggctcactgcaacctctgcctcccgggtttaagtgattctcctatctcagcctcccgagtagctgggtttacaggtatgcaccaccacgcctggctaattttgtattttttagtagagacagggtttctccgtgttggccaggctggctttgaactcccgacctcaggtgatccgcctgcctcgacctcccaaagttgctgggattacaggcgtgagccactgcgcccggctgacttttttttttttttttgagacggagtatcgctcttgttgcccaggctggagtgcaatggcacgatctcggctcactacaacctctgcctcccgggttcaagcagttctccttcctcagcctcccgagtagctgggatgacaggcatgcgccaccatgcttggctaagttttgtatttttagtacagatggggttttaccaagttggccagggtggtgtcgaactccggacctcagttgatccgcctgcctaggcctcccaaagtgctgggattataggcatgagccactgcgcctggcccagctttttttttttttttttttttttaaaggttgacttattcttatagcccacagatctgaagtaacaaatcaggtgtgggcagttcatatctgccagaggttctcattcatctttttttttcttttcgtgggatggtttttttggtgagttgtttagtaccagtcttcccatttatgacctctaacaagaaacacagaaaagtattattgccaaagactaatactagttttcctaaagagaaagaaaaatgcattttactttcaactttttttttttttttttgagacagggtatcgttcatttgccaagggtggagtgcaatggtgtcatcttggctcactgcaacctccgcctcctgggctcaagtgatccttccacctcagcctccccagtagctaggactacaggcgcactcagccacacccagctaatttttgtattttttgtagacaggttctcactctgttgcccagggtggtctcaaactcctgagctcaggcaatcctcctgcttcggcctgccaaagtgctgggtttataggcacgaaccaccactcccggccacttttaacttcctgattataaaataggaacatagtcttgtagagatctttactttttatcatgtatactctggatgtgtttaaaattaatttagggagagtttttggaatatgtgacttctggttcttattctatgcattccattccttttaaattttgatgctttgttatgttaggctctagtttttgtagttccgcttaacgttagggtaaaccattttcatatgtgaatatattgataatgtttcttactagaataataaattctaagaaagtagcctaaattttttgctttaccaaatattatttgaagttactagatctcaactggtctgggtaccaactaattttatagagataaactttgctgtaatgttagttttaaaaatttgacttacatttgaacatacgtctatgtatgctcagaatattaaataatttacttccccacaaaaggtagtaaaactcctttctttctttttctttttttcctttttttttttttttttttgtgagacggggtttcgctcttattgcccagactggagtgcaatggcgcgatctcggcttaccgcaacctccatctcctgggttcaagcaattctcctgcctcagcctcccaagtagctgggattacaggcaagcgccaccacgcccgactaattttgtatttttagtacaggtgaagtttctccatgttggtcaggctggtctcaaattcccagcctcaggtggtccatgtgccttggcctcccaaaaagtgctgggattacaggcatgagccaccgcgcccagctgtaaaactcctttcaacatgtatgttatgtttttgtcttactttatgagaggtactgtaaaaattgaagtattgaggctatgatatggtcattgtgaatttcagtgaagactactgtgttcttcatttttacaatttacaaagcccgttgttatatattctcatatttaatatgtgtaagatataaaataaaatgagcatccctgaaactatcacacagcttaagaattagagtattaacaatatcattgcatccacctgtatttttcttcctatattattcctttcctttcctttcgagataatcactattctgaactttgaatttgtcatttctgtggtctttaaaagttttatcctatgtgtgatatataagcattacttgtacgtttctcttgagctctatgaaaatatcagtgttgccttttttttttttttgagacggagtcttccactgttgccccggcttgagtgcagtggcacgatcttggctcactgcaacctccttccgggttcaggcaattctcctgcctcagcctcccgagtagttgggattacaggcgtccacgaccacactcagctaattttcagtgttgcctttttctttttttgagacggagtctcactctgtcgcccaggctggagggcagtggtactatctccgctcgctgcaagctccgccttgccggttcacgccattctcctgccttagcctcccgagtagctgggactacaggccttttaagatttagtcatataattgtgtccgtaggccattcacttttactgctgcatagtaatctgttgagtgaatgtaccgggttttaagatttttatatcaaaggacatttgcttagctttttttttttaaaccatgtgaacagtgatacattgaacatttttgcatatgtttattaataaacagatttaacgtttatgttgggtgtatgcttgagagtagaattgctggggtatgtttattttcagctttacaatattaattgcttcttcaaatatgctattaggatatttaaaactgagatgaaatttacataacatacaattaacggttatataaagtgtacaccttaatggtgtttagtgtattcacagtgatacacatccaccatctgtctctagtttcagatctttcttgtcaccttagaaaaaaaaccccatttctttcttctcccaagccgtgataactgctaatctgctctctgtctctatggatttgcctattcaggatatatcacataaaaggaatcatgtgactttttttgtttggattctttacttagcataatgaatttgaggttcatccaagttgtagaatgtgtcagtacttcctttcttcttatggctgtatgatagttctactgtgtatatttgtgccacaatttgtttatccattcattcattgatagacatttggcttatttccatttggctgttatgaattataaataatgctgctttaagcatttgtgtacaaggttctgtgtagaaatatgttttcatttcttttggatatatacctaggagtagaattgctgatgcttgtttttgatagtttctcatttcttccttgtaattttttttgatacataggaattttttttaaaacattctccatttgataattccagtgtctgaaatccttgggtatataaatggttttttgtctcttcctcattgaggtttgttttcatttgcgtttgttcttcgattgcaagtttatatttgatcttaatctgttggaatcttaagggcctaaattggggattctttgccccagagaacatttcttttgcttctgctagttgctagggtgtaccactgaactgggaacgcttcaactcctttcctacctgtgtatttgtaaaatggatcagacccttgccagcctaatgtggcaggctctggttcagcaccacaggtttgctgctggcccaaggctttctaatccatctgaggattgaaaatggccctctggataacccagtttttcacatttgctcactgcatacttgtgtctgttcactttgtttttttatttttgagacaggatctcgctgtgttgccagactagagctcagtggctattcacaggaacggtcatagcacactgcacctttgaactcctggcctcaagcagtcctcctgcctcagctttttgagtagctgggacttcaggtgctcaccaccatacctggcttcagttcacttttttgtttttgagattgctagacacccaagaaataggaacgatgtgttaaaacgctttatctaggagctagttattttgtggtgggagggcaggtcattttgacgagcttactgagtagaagagatctttgtagatcttccaaagtttcttgtgggtaaaacatgtgcatttagcaatctgacaaattttcttgaggaaatttggattgggaatacctttaaagggcaatacgtttgtaaaatgcagtggttaagaacaaccattgttctcttcttggacgttcattgtataagtgttagatttttgttgttgttgttgttgttgttgttaactattctctggttgtaagcagaggataagatctaaataatttatgccatacatttcatagttatggcttcactttatattggagtgaaataaaagagtgaatattccaggcatggtggctcacacctgtaatcccagcactctgggaagccaaggcgggaggatcacttgagtccgggagtttgagaccagcatggacaacatggtgagactccatgtattcaaaaaaatctttaaaaaatgtagctgattttgtggtggcatgcatccatgcatcctcccactttgggaggctgaggtgggaggattgcttgagcctgagaagttgaggctgcagtgagctatgaccatgccactgtactccagcctggacaatgcatcaagaccctttgtcaagaaaaaatatgtatattgaaaaatggcccttgtttagactttcctaatgagatgtaaattttgagaaataatagttattatttatggactgcttatatgtgctagcactgtgctaaatgtttacatgtttaattcttataaatactctatgaagtaggtgtcatccccattttatatatgcaggaaaagtacaggaagtcaagtgtacttttgtaaggtcacaaagtacatgataaagctaggatacaaacctaggcagtctgccctcagaactcatgtgattaaaatactgttctttgtcactgtagtgagaaggttttagaagtagcaaataatggtagacttaaatggattattcctaatgattttcttaattttgagaaaagtgaaatactaatagacacattttagtaacttatgctggatattttgttgtggttttctgatttcatttatgtcccattcataagccattttaggggactatattccatattaaaacattcttaaactgaaatttaccctttatagccaaaatgtatttcattgtaccattttttttttaccacattaacatctttattgagttgtattttatacaacataaaatttacccatttcaagtgtacagcttaatgaattttagtaacttaagtgagggattcaactatcactgtaatttaggtttaaaacatttttatcccctcagtaaaatccctcttgcctgtttacaggagcttcccttctcactgtcagccacaggcaaccaccactaatctgtatttttttttttttgagacggagtttcactctgtcgcccagggtggagtgcagtggtgtgatctctgctcactgcaacctctgcctcccaggttcaagtgattctcttgcctcagactcctgagtggttgggactacaggcgcccgccaccacactcagctaatttttgtatttttagtagagatgaagtttcgccatgttggccaggctggtctcaagttcctgacctcaggcaatctgcccaccttggcctcccaaagtgctgggattacaggtgtgagccaccacgcccggcctctattttttatctctaaaaattcgtctttttctggacatttgtataaatggaatcataaaatatctgttttttgtgtctggcttctttcacttagcataatgtttttgaggttcatccatgatatagcgtgtttcattagtttgttctcttttattaccaaatagtaataattccattgtatagacaacattttattcacatactatttaaagataatatatttctagactggatgagacatttaccaactttgctaagtatggtatagtatagtggtgactcagtattttttaaattaatccaccaattatgcttttttgtaatatggtaataatttccctgtttaaactatgattctatccagggcctattgttcctttactaaatggacctaggtggtcgaacttgagttcttgtttctacatgtgatcatttttctttctctttccctgtttaccatttgttttgcttctttaaatgtacctacctttagcaccctccctccaacacttttcttttttttgagacgggagttttgctcttgttgcccagactggagtgcaatggcgcgatcttggctcactgaaatttctgcctcccgggttctagcgattctcctgcctcagcctcccaagtagctgggattgcaggtgcctgccaccactcttggctaatttttgtatttttagtagagacaggttttaccatgtaggccaggctggtcttgaactcctgacctgaggtgattcgcccaccttggcctcccaaaatgctgggattacaggtgtaagctgttgcacctggctcctccaacactgttacagtaaaaagatctggactgaatcctaaggatattttccatcaataaagcaagaagaaaataagaatattgtggcattaatttttggcaacttggattcccatttgtggctttcctaatttttaagctgttttccaggcccctgcaataagagagacgttatgggtttttctgtttctggaatcgattttattctgctggcgatcagcacttttttatgaggtatttgggatacaaagatggttaaaacactaggtttaaattagagttagacatatttcaaaaaaaaggcaggaatagtagtgcatgagtaatatacctttagtaattaacatcccgtatccattaattattaagcatttgcacaaaattttggcagactttttttgcagtcatgaaaatcacatttttccttttaaagtcatgttggaatttaagttatagtatgttctttattacaaagatttaataaaaggctttgcttacatggcatgtttagaaaagaaaaaacatgaaaactactctcttgaaactcattttctgtttaaactttgatgttaaaggtgcttctcagaatgatgatggctccagatccaaggatgaaacaaggtaagcattcactgattgcttaccacagaatgcggagagatagatttcctaaatattcattttagtgtaaacttcaggttcatgatataagaataaatgagtgtcagaaagaattcagaactcaagaagggaaatatttgcaaaagattgaagactcttagcttatcggattagagctatctggagtgggctagggataaccaaattgttgatacttcttcagcttgtagaaaataaatatactggcaccttttcagaggcagggtgttctaaactccagagccatcattgggctgttaagtttcttttccagaaaaactgagataggagctttacacatatgtgaaggtcaccactagctatggtatcatctgggccttcattagaaggggcagagctttgtaccagctgtttgctgttagcccaggtttagcactttcatgtgcctatctgcgttcaagtttggacctaaatgtggggaaaagaaagaaagatcagtttgttactgtgtctatgtagaaaaggaagacgtaagaaactccattttgatctgtactaagaaaaattgttctgctttgagatgctgttaatctgtaactttagccccaaccctgtgctcacagaaacatgtgctgtattgattcaaggtttaatggatttaggtctgtgcagaatgtgccttgttaacaatatgtttgcaggcagtatgcctggtaaaagtcatcgccattctccattctcgattaaccacggacacaatgcactgcagaaagccgcagggacctctgcccaagaaagcctgggtattgtccaaggtttccccccactgagacagcctgagatatggcctcgtgggaaaggaaaaaccttacatcctccagcccaacacctgtgaagggtctgtgctgaggaggagtagtgaaagagggaggcctctttgcagttgagataagaggaaggtttctatctcctgctcgtccctgggaatggaatgtcggggtgtaaagccaaccattcgttctattctgagataggagaaaaccgccccgtggctggaggtgagatatgctggcagcaatactgctctgttactctttgctacagtgagatgtttgtgtaaagtgaaacataaatctagcctctgtgcacatccagacatagtacctttccttgaacgtattcatgatacagattcctttgctcacatttttccctgctgaccttctccccaccatcaccctgttgccctgccacactcccctcgccaagatagtaaaaatagtgatcaataaatactaagggaaatcagagaccagcgctggtgtgggtcctcacacgttgagcgccggtctcctgggcccactgttctttctctgtactttgtgtctgtgtcttatttcttttctcagtctctcgtctccacctgacgagaaatacccacaggtatggaggggcaggcccccttcatctaaaaggtgttgaaagccttggactatgtgaattaacttagactgcttattggttatcctggaaatcggtaacagcagataaaattaggaaaggagatgattctgcttttaaagtagtgagtggcatgtcttaaccacagagtgcagtgattataaaattccatttgattctttgtttttctcaaattgcataagcagtgagtaggaagaagatgatgaaccacaggaggagtagtcagaaggggagaagaacgagaaaagtaatgtcacagactgtgagggaaaattatccacaaagatgggatgttacagtgtcagatgctgcagaggaggataggtgaagaaagtagaacaaaatactgatggttgttgaagctgtgctgttaggtacatgggagtttattgtattagtctatctgcatttgtcatctatgggttgttttttttttgttttgtttttttgtttttttagatggagattcactctttcacccaggctgaagtgcagtggcgcgatctcagctcactgcaacctccatctcccgggttcaagcgattctcttgccttagcctcttgtgtagctgggactactcaagacaggcatacaccaccatgcccggctgtttgtatttttagtaagagatggggttttgccatattggccaggctggtcttgaactcctgatctcaagtgatctgcctgccttagcctcccaaagtgctgggattataggcataagctgccatgcctggccgatagatatatggaagttttttggtttttttttttgttttttgaggtgttgtctcactctgtcacccaggctggagtgcagtgacacaattttggctctctacaacctccacctcacaggttcaagcaattctcctggctcagcctcccgagtagctgggattacaggcacccgccacgatgcccagctaattttttgtatttttagtagagacggggtttcaccatgttggccactatggtctcattcttctgacttcgtgatctgcctgcctcagccttccaaagtgctgggattacaggcatgagccactgcacctggccaatatatgaaggttttcataataaaaagttaaagacaactcatcaagatctttaggaaaatcaaagtttataaagctgttgtgtcttacctaataggtatctgctttcacattcttatgatgaagaatcatctatactaatctcacgagatgtagaatattaaggagcagtaacttcttgcctagaaaatagcagatacttttattctttactgtgattaaaatcaatggggccggtcatggtagctcacacctgtaatcccagcattttgggaggccaagacaggaggatcacttgagcctaggagtttgagaccagcctgggcaattgagtgagacctcatctctacagaaaacaaaacaaaacagaaaaattaaaattaaaaaacggtagttaggcctggtggcacgtgcctgtagtcccagctgttggagtggggagggtgcccaaagtgggaggatcacttgagctggggagatcagtgagctgagatcgtgccactgtactcagagtgatgacagttagaccctgtgtcaaaaaaaaagaaaagcaataggacaggtttaaaaaattacataaatatctgtagactgaatactattatgtctcttttgtctttttttagtattattatatttagtagaagatttcttgaattcctgaaagttcccgcataaaatgttttagtatttcagtttgctttggtcatttacctcttcttttacacaataaacctgtatctttgtataataagtgggtatgtaaaaggttctgttatgccagtgtgttgttgcttgtttgttttctgcaagtctctttcttaacagtattttcatcaaaccacttgtactctggacatctttaaatttattataaaggcattgctggatcccctacttaatgctatttaatcaatgctttttatcttcctaagtgaatcattgtcataaataatttggggaacaatgtcttctgggtttctgagactgcctgacaaatctttgagtatgtcttttgtgttaagcataagttcctgtgcatcagcttttattccagagcacacacacctttgagatgacaggtttgaaaagcattttgtaaactgtcaaaagctgtttaaatgttactacacaataatgagtagtagtcatagctgtgactgccttttctcctttgcttttgtttgcagatttcatgactataaaactaaaaggcagggaagtatatatgtagtggacaggtgcttcgcatccttccctccatcctcatagttatcgtttaggaagtttactaatagccttaggttattttagcttttgatcttaattcaagcactgtctgtatcataaatgtgtttattgatctgttttccccacagcatgtctggatgttttatgtttctcagtgttgtcttctgtttatttgtttatttttatgaagtaccaagattattggtgcctgattttcaagattttgtcgttagatgtgcgttctttttttttgtttttaagtttattattatattttaaagacaggctctcgctctgttgcccaggctggtctcaaacttttcacctgaagcatttgccctatctcggcctcccgaagtgttgggattacagacatgagccaccacgcccagcacatgtgccttcttgattgttactctttgatttgaacatttatgacctgattgtactataatagcattttggttgtctgaggttctctatcctgtccataacttatgaacttatttataggtcagatgtatatgtatgttgaaattagcagatgtttgtaagattgtggaataggggaacaaagttatagtagcacataattagcagctaattgcttttctttttttacttttttgtttgagaccgtgtctcgttctgttgcccaggctggagtgcagtggcgtgatctcagctcactgcaacctccacctcccggattcaagtgattctcctgcttcagcctttcaagtagctgggattataggcatgcaccaccacgcccagctaattttttgtatttttagtagagatgaggtttcaccatgttggccaggttggtctcgaacttctgacctcaagtgatctgcccacctcggacctcccaaagtgctgggattataggtgtgagccaccatgcccagccagctaattgcttttcaaagccaattggtggtgttggttccactgacaattctgtatactgtatagatttccggattgattttcaaaatctatttttagttttagcctcacactttactaaaataacttaaacttattaaaataaataaaataaaccgccagtactattttagtatggccctgcttctcaaactttagagcacattagaatcacctggttcattagatttggggtgggactcaagatttgcatttctaacacatttccatgtgatgctgatgctgctagaccagggtctacattttgagaacacaatggttagacacacacgtttttgcaaattataactattctgggaaataataacagatagtaaaaacagacttcttatataatttttcattatataagaagtctgtttccccaaagtccgagcgtgcagaatttgctagaactgtcaatctgtcttaatttcatacccttttgagagctgctttgaatcttgttttttttgaactgttgtttttatgtttattattagaaaataatacgattgttttaaaagatgtaaattaaatagtgtgtaaagtaaaatgtataaagccttaatagaagaaataatatttgacctaagaccttaaaacagagctataaactgtatatgcatgtcttagaggaattggagggaagaaggaattctaaatggaaagaagaaaaacaaaggtggtgagaaacacaggttgttttgtaggaaatctttaatcataatatttggctaaaggtgcagtaatttcaagggagaaatggcatttggtgattagaaagtagaatcagtcaatatatatttatttgcctttatatgatagacactatgctcaacatgtctattcttccttcagttagtccttaaacgtttatgagttaggtactattgtctcatttttataggtgatgagaaaacaagcttagaaagggaaaggaacttgcttgagttaatagcgttaagtgggacagttgaacctggaacagccttaccttcagagcctgagctcgtaactatcatgctttactgccacctgaagttgggatgatatacaagtaagtgcttagccattaataaatgttatttttattgttagataggttgggaccagatggaggtttgcaagtaaagacttacggaattttttttttttaaaggaaaggaatgtcttttaaaataatttgattttgttctgttttgttttgttttaagactgagttttgctctgtcgcccagatgggaatgcagtgacgcgatctcggctcactgcaacctctgcctcctgggttcaagcagttttcctgcctcagcctccgagtagctgggattacatgcgtgcaccactagacttggctaattttttgtatttttagtagagatggggtttcaccatgttggccaggcttgtgtcgaactcctgacctcaggtgatcttcttggccttcttggcctcccaaagtgctgggattacaggcgtgagtcaccacgcccagcctaaaatatttgaacaggagattgtatgatcagaactctgtaggaaaaaatattttgacagtggtatatagtttggattatgtggtggtgagtgaaggttgaaagtcctatatggaaatttgttacaataatctattgagaggtaacgaaggctagaactgaggcaatgatggtggaagagtagagggagaatgtgaaagtgggatcaacaggacttagatactgagtgtcaagaggcacagggaggaaaaatgtaaaattgcctgggaaagacagcagtatcgttcatagaaccaaaacctaagaaggaaggaagaccataggaagagaatgtttagagggacgggaggacctggcagggcatggtggctaacacctataatcccagtgctttttgggaggcccaaggggaagattgcctcagcccaggagtttgagaccagcctgagggacaaagcgagaccccatctctacataaaataaaaaattagccaggtgaggtagcatgctcctgtagtcccagctactcaggaggctaaggcgggaggatcccttgagcccaggagttcaaagttgcagtgaactgtgattgcgccattgcactccagcttgagtgacagagcaagactcttgtctttaaaaaaaggaagaaagggagggccttgggatgggagagttattctagatctcctgcatttagttgataatttgatactagaggatgggagtgagataaagagtagagattgatttgggaatcattctctgagataaccttagaaatcatggaatttgagatcctagggaaaaatctgtggagaaagaaaaggagaacaagaacacaatcatagagacctatatttagtggatggtaggaagaggacaaaccaaaaaagggatgatgagaagtgggagtacaagattacaaaagcactgtcacagaaattaagagaaaaatgttctttaaaagatgggacatttggccggtggcggtggctcactcctgtaatcccagcactttgggaggccaaggtgggcggatcacttgaggttaggagttcaagaccagcctggccaacatggtgaaaccccatctctactaaaaatacagaaaaaagttagctgggtgtggtggcatgcgcctgtaattccagctactcaggaggctgaggcaggagaattgcttgaacccgggaggtggagattgcagtgagctgagatcatgccactgcactccagcctgggcgacagagcaagattagattctatgtcaaaaaaaaaaaaaaaaaaaagatgggacatttaacactatcaaacgctgcaaaagagaattaagtcttagattaataagctagggaaaactggctgtttggaaaaagaaaagaaaaatcaggttaacgccttagcttatcccaagatgagagtagattcgatgttgacttttaaattgattttaaaaaattaaactaaaacctctagaagaaaatatgaatagttaattcattgctgaataaatttagctatatagaaatataaaactcttataatttaaaaatgtattatcaaaagcaaaggaaatatttaaccaatatgagatgctcagtattctcaggttgtaaagatctcttaaaaataggcaaaattattcccttgtaatagataaatgtacaaaaaacatatatatagttcatgaaagaagaaactgtaatgacctgtaattatatgaaatattgttcatctttaattttaaaaagcattaacatttttgcttaccaaattggcaaagattttaaaactttatggtgaaatgggtgtttttattttgcggtacataatttgaaaatgtccagcaaatgggagaacaggtcaattattacctttaaaactattttttagggccaggcacagtggctcatgcctgtaatcccagtacctttgggaggccaaggcaggtggattgcttgaatccaggagttcgagaccagcctgggtgacatggcgaaaccctgtctctactaaaaatacaaaaaataagtccagaatggtagcctgcacctgtagtcccaactacacaaaaggctgagtcaggagaatctgtggaacctgggagatggaggttgcagtgagctgaaatcatgccactgcgttccaggctgggtgacagagcgagaatctgtctcagaaaccaaaaacaaacaaacaaaaaaacactattaaaaagaaacaatttaggccgggcgcagtggctcatgcctgtaatcccagcactttaggaggctgaggcaggtggatcacctgaagtcaggagtttgagaccagcctggccaacatggtgaaaccccgtctctactgaaaatacaaaaattggccgggcatggtggcaggtgcctgtattcccagctacttgggaggctgaggctggagaatcgcttgaacccgggaggcggaggttgcagtgagccgagatcgtgccattgcactccaccctgggggacaagagcgagacttcgtctcaaaaaaacaaacaaacaagcaaccagtatttttcagctttcaaaatatttgcatgttttgacttggttgttctattctgcagtctgtctaaaagaaataagaaatccaggcagggcatggtggctcacgcctgtaatcacactttgggaggccgaggtgggtggatcacttgagcccaggaatttgagaccaccctggtcaccatggataaaccctgtgtctacaaaaaatacaaaaattagccaggtgtggttgggtgtgcctgtggaataggaggatcacgtgagcctggggaggtcagggctgcagcgagcagtgattgtgcctatgcactccagcctgggcaacagagtgaaacaatgtctcaaaaaaaaaaaaaaaacccaaaaagaccaatgaaaagaaagcgattaaattgtagtatgtctatatataattttctgcagtcattcaaaatgattttcagtaatttgggggaaatgcccaatatgtattgagtaactaaccaaataaaaacccacccagaatatgaaaccattatacagtgtgtgattgcagtcacatccaatgagaaggactgacaagagatagtcctatgtcttggtggtaattatctccaggatgtaggatggcagataatttttattttataattagaagttacttttgttctttgaaagtctgttttaaaaattaaaatgggggctaggcgcagtggctcatgcctataatcacagcactttgggaggctgaagtgggcagatagcctgaaccctggagtttgaaactagcatgggcaacatggcaggaccttgtctctacaaaaacatacaaaaattagctgggtatggtggtgcatgcctgtattcccagctactcaggagactgaggcgggaggatcatatgagcctgggaggtgaggcgggaggatcatgtgagtctgggaggctgaggctgtggtaaaccatggttgtgccacggcactccagcctgggtgacagaggaaaaccctaagggaaaaataaaataaaatgcactaactatattaactgcattttaaaaaagagtatagtgaaggaaaggggaatgggaagacagcttgaggaacagataggattgaggaaacattttaggtttgggtgcttgattatatttgtagagtaagacaaaaggtctataagaaaggaatataatgaagatgcaagaaagcattaaaagatgttgggcagtcctagaggatatagtctgccatccaggacatgataggcaaatcatccttgaagaaggggagagagactttttcagacatgggaaacagatggagatggttagtggcacagagaaattttaaggtatgggagaaagttgagggatagcagataatcattatttttagggaagaggaagagtcagggatagctacagattggtattagcaatttgaggagatggaaaaggtttgcaaggggcactggggatgggtccaggagtggattagagatgtagaaactgattgatttctaaacaatatagataacccaattaaagttgttgaataatgtcagctgtagccaatgttggcttggtctctttgacataatccagttttaggtatttgaatactctataaatacaaatacatagactgaagcacaattttaatttttttctatcttttgcctaggtctgtatgattgtataggacttagagctttttgtcctaccaaattattaatttctttattcccattaattttaataccagcacactaatctcattaaacccatggttttactactaggttgtcaaagtcatccgtcatttataattccctagctcccaggagtcttgagctgtgattttttggtttgtttgtttttgggttttttttttttgagacagagtcttgctctgttgcccaggctggagtgcagtagcacaatctccgcttaccacaacctcagcctcttgggttcaagcgatcctcccagctcagcctcccgagtagctgggactataggcgcatgccaccatacccagctaatttttgtatttttagtagagatggggtttcgccatataagccaggctagtctcaaactcctgacctcaagtgatctgtccaccttggcctccttaagtgctgggattacaggcgtgagccactgcagccggccgatttcttctttttaataagaggggagaaaagagtttttgtctttaataattggtagtgaaaacctctgaccttttctttactgggcccagtggaaaatttattagaattgtttgtagagcagcctgccctttaatatgctactttacttagtttatttactccactaaaatacacctgacttctcaactggaacattctccagcattacttgttggtctgaggaatagtagtgtaaaaagtagatgaggggttagttgtggtggaagaatttctgggaggggaagcagttgggcaagggtgaaggaattgaaactactagggaaagtagcctatgatgaagcccaagtgaggcgtgaagtgagctgatgaactgtaaagattctggaaggagttgaaggttgtgatgagactgaataaaagatactgtaggaggcaggtagaataaataggaagttgtagttagagggattttagagttcaagatctaggaagaggaacaattctaagtatcaaggaaatttaaggagttgtacgggttatcagatgactccattgaaaaattgagatcaaaatgttataagggtgtacagcattgatgttaaaattccccaaattttaatccccagcaacaaatcatagcatttttggaatcctgtttctgctgtacctttatcatagtaggtttatctcatgcactgaatgttccttctccctcacatatccctaaaacttgtctagcactgaatgtgcaatttagtatgaattttctagctgaaagatttttaggcatcttgtagtcaagataatacattttaggatgcattcttgggtcacataactcatcagtagcagagtcagagctagaaaccttaatttcccaatttttggtctattctactcattgttatctgttatttaaaaagcagcaggaactcttctttcaaactagttaggaacgtcttaaaatagcatggagaggcaatacgcagtcttaaaatggttttggaaacctcacttagaagaagagaagcagtgtcaaagctgactcttcctgcattcagaccatgttctgcaggtagtcaacactaatcaggtgctgactgccaattactgaggtgttccctctattataagcatttggggaacccccaaagtagtgcttgtcataccttactgtccacatatataatctggggatcttgttaaaatgctagctctgatatagtaggtctagaatagttttgaagattgtgcatttctgacaagctcctgtatagtgctcgtccgtttggtttaaagaccacactttgaatagaaaggccctaaaggatttctgtggtacacagtttgaaaatgtcttttaaaatatgaggactggtacgcagtggctcgtgcctgtaattgtagcactttgggaggccaaggagggaggattgcttgaggtcaggagttcaagaccagcctgggcaacatggcgaaaccctgtctctacgaaatacacaaaagaattagctgcgcgtggtggcaggtgcctgtagtcctacctactcgggaggctgaggcatgagaactgctagaacctggtaggtgaaggttgcagtgagccgagatcacaccactgcactccagcctgggcgatggaatgagacgctgtctcaaaaaaaaaaggaaaaagaaaaaaactatgtgaggagagagagatgttaattagcttgactgtagtactttttttcactatgtatatcaaaacatcatgttatactgtttttattaaaaataaatcattgcaatacatgttttacagaaaaaaaatttaatacatggtactgcctctctgtttctttgtttgtttgagacagggtctcactctgtctcccaggttggagtgcagtggcgcaagctcagctcactgcaacctccacttcccagactcaaacaatcctcccacctcagcctcctgagtagcttcgactacaggcgtgccctgccatgcccagctactttttaaatttttttgtacagacagggccttgtcatgttgcccaggctgatctgtcactcctgcgcttaagtgatcctttcacctcagcttcccaaagtgctgcaattacaagcgtgagccacagcacccggcctctgttagttgaatctattagattttattttgttcaggcttattctgaaattcctaggagtatgggttagtactgtgtagtggtttggaggtagtacataccagagccttggctgagacatctgcagactggctacttatgcccttgtttctaatctatgactagagcccctctggaaggaaaaggaatcagctatatttagccaacagtagcagtagctttcagtctgacatttcctgttagtgttcttccctcctttctatccctccagttgatgtcattgctttgaagaaatgacagctcctttaaaaaaagtctgtggttacttctactctaaatcactagctttgaacattttgtgtaccattgtactgagctgggggatatcagggcctagtccctgggaaatacgtgcactttgttctcctagcatgggaaaaccagacctgcctcaaacttgaattaatagccagtggaaatcaagaaacaacaatggtaaagttatctgtgcttgtgataaaatagtgccctaaggattttgagaacttgactttgttcctgttcatatagggccttctgaaggcttatttgaaatatgaaccagcatacctaatagttctgaatggccacaagtgttcctatgcccttggacaacccatcactctatctctagatgaactctgggggttatataggattctacccaaaggctctttatgtatttaataaggctgaccagaaattaaaaagcttttttgaagctcttaaaaacttagaagttttcatcctcctgctgttttttttcttaaattcaaggagtattcattatttccctctcccccttccttttcccctcttcttacccagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccaggtttgtattccagctctcaatactcttggaaataatgtcctggttggcaattaatcctcaggtaagtgtcaggaaattcttttaggtgaattttctgcgtgtatttttacatttaagattttggaaaagaatgatctttctgtaggtaaccaaaagtgcctttttcctaagtttttgttcaaggtgacgttactgaggcagtgctctactgagaatgaaaatgacatgtgcgtaatataaagtataggcggtgcagataacatggcaataacattgtacctttcttaaatggtttgtaactataacataaatgtattaaatactcaaggatttggttgcttattcctagtatatcctttaaaaagttagtaaacgaaaacccaacaatgctaaatgacccagattttaaataaaaagtacacaacaaacaagcatattttaggtagtaaaaatgtgaacacctataagactatccacttctctgatagccagaacaaatctttaatcttaccttttattgtttctctctgctaatatgtgggcagggaatgcagtgtagttaaaccaaatattactagaaaagtacattagttctctgcaaataattttaagtgaatttctattcaattatacatcttctcctttttatttttttattttttgagacagggtctcactctgtcacccagactggaatgtggtgacatctcagctcactgccacctctacttcccaggctcaagtgattgtctagcctcagcctcccgagtagctggtaccacagtcatgagccaccaatgcctggctaaatatttatattttttgtagagatggagttttgccatgttgcgcaggctggtctggagctcctgagctgaaagtgatccttctgcctcggcctcccaaagtgtgggagttacgggcgtaagccactgcagccacatcttccccttttatagataatttgattaattgtatattctgagtctttaagatgtctttattataatcttggtgacttcctctagacattgttttgtccacaagtatttcttaaaggtgtaatgtatgactactaactatctgtaagaatgttatttcttatcagaccttccatattataaccaacatcaaaaattggtctgtaatctgcacggtttcacaggaaagcagttttaaggagctggaaaattaataaatgaacttaaaataccaaggaatattaataatttcctattctaaaagtttttatttccagtgacatcagaagatcagagaacctgtacatgcttcgtgattagtaatgggacataggggtagacaggaccgaaaaagtaaacaagcctattaactggcagcgttggttatttcccattacttatttctttaagtaattttcacctgtgcatctacatcttaagttttatatttatcatctgccttttattttttacagttaaaattctatcctgaattttagaaaatgaaagattcttttcctattttccccaaatcttttatagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctgggtgagtaactttttaaattaacatatgttgtctttaggattcttcataagcctacttattaataaggaaaataacagtaaacaacagtaaactccattgttttgatgactgttttttaatttcttttttttttgagatggagtgctctgtctcccagactggagtgcagtggtgtgatcttggctcactgcgacctccgccccctgggttcaagtaattctcctgccttagcctccctagtagctaggattacaggtgtgcactaccaagcccggctaatttttgtatttttagtaggggatttcaccatgttggccaggctggtctcgaactcctgacctcaagtgatccgaccacctcaacctctgaaagtgctgggattacaggcatgagcacccagccaactgtttttatgttattgtaactgattttgggggatctggagtcaaaatgaacaaggaaaacacaccatatttgaaatcttcagggcaaagtggaaaaatatattttttcatcaaaggaccctgaaagttaaccaaggccaattaataaaataatcacctaattccaattgcctttttctttaagggggaaaaaatccctttttaatatcaaactatttttttcatcagaagatcattataggctgggcatggtggctcacgcctgtaataccagcattttgggaggccgaggcgggctgatcacctgaggtcaggagttcgagaccagcctggccaacatgctgaaaccccatctctactaaaaatacaaaaaattagctgggtgtggtggcaggcgcctgtaatcccagctactcgggaggctgaggcaggagaattgcttgaacctgggaggcagaggttgcattgagccaagatcttgccactgcactccagcctgggcaacaagagcaaaactccatcttggggaaaaaagaaaaatcatagcaaagtgatagataattcagaaaactgagaaaatttgtgctcataatcccattttaatctctcctgattattttaagattattttcatagattgtttttaagatactcaggtgtaattttttcttgtttattttttgtttgtttgtttgagatgaaatcttgctctgttgcccaagctgtagtgcagtggtgggatcttagctctctgtaacctccgtcttccgggttcaagtgattctcttgccttagcatcctgagtagctgggattacaggtacctgccaccatgcccagctaattttttttttttgagatggagtctcactctattgtccaggctggagtgcaatgatgcaatcttggcttactgcaaccactgcctcccaggttaaagtgattctcctgcctcagcctcctgagtagttgggactacaggtgcccaccatcatgcccagctaatttttgaattttcagtagaaacggggtttcaccatgttggccaggctggtcttgaactcctgacctcaagtaatccacccgtctcagcctcccaaagtgttgggattacaggtgagagccactgcgcctggccatttctttccactcaaatcctgattataccctgattgagagtgacttcggtatcctaggtagacggacctcaagcctcttcaggaatatgttttctcctagagcagatacttgcatagaagaaattgaattcactgtgtgccactgcctgaagattacatttcttcactttattcctaaattgtatttgtatcatctttctaaactgatgtccttatttgccttagttcaataatggtcatttaatggaaatgcaaagacaggattaaaaagccaggtaactcatgcaagtattttaccagccttttaattttgtatttaagttgggagcagagagtggaccagcacgggcgagtttactatgtagatcatgttgagaaaagaacaacatgggatagaccagaacctctacctcctgggtaagtatctaaatttaaaaagaataattttatttagtcagaattgtggattacaactgtataatcttccctacatttctgttttactttttcttgtcagccctttctctgtccactttgttttgtggtaagtacaaattaaaaagaagagagctagacaactgattaattcagagcctgataaacaatttttgttttcacgcatatttctttcttcttttctttattttatagaaacaacatctcgctatgtcgcccaggctggtttttaactcctgagctcaagccatcctcccgcgttggcctcccaaagtgctgggattacaggcgtgagctatcatgcctggccctattttcactcatttctgacctaaagattccttaggtgggctgggcgcagtggctcacgcctgtaatcccagcactttgggagggcgaggtgggaggatcacgagctcaggagattgagaccatcctggctaacgtggtgaaaccccgtttctactaaaaatacaaaaaaaaaaaagccaggcatggtggcgggcacctatagtcccagctacttgggaggctgaggcaggagaatggcatgaacccaggaggcggagcttgcagtgagccgagatctcgccactgcactccagcctgggcgacagagcaagactctgtctcaaaaaaaaaaaaaaaatttccttaacttttcttgtctaagctgtttacctgtttactaatactgtagtttaagtattagtttcttcaagagtaattatttaaatgaataagaattagagcccagtcatatattaaaatgaagttcttattatatttaaaaaactataatagcaaaatcatttcaaattaattggggaagttaaggatatattaatacatggtgttaagcctttaacattaacattaacattacagtccaggcacggtggctcgcgcctgtaatcccagcaccttgggaggctgaggtggggggatcatgaggtcaagagatcgagaccatcctagccaacatgttgaaaccccgtctctactaaaaatacaaaaattagctgggtgttgtggcgcgcctgtagtcccagctactccggaggctgaggcaggagaatgacttgaacctgggaggtggaggtgcagtgagctgagattgtgccactgtactccagcctggcgacagatcaagactccgtcaaaaaaaaaaaatcatataaaataattgaagaaaaaatattttttaatccagaggaaagtcagtaacaaacatggaaaaatacttaaccttgttagtaatctgaaggaaatataccctgaaaaggtactgttttagttattaaattagcagataatatcaagtgttggtgaggaactttacgttgttagttgctgccggggctgggcacagtggctgatgcctgaaatcctagcactttggggggacaaggtaggatgggcgcttgaggccaggagtttgagaccagcctgggcagcatagtgagaccccatcactatagaaagaaaaagaaattagctgggcatggtggcatgtacctgtagtcctagttaatcaggagtctgaagtgggaggatctgttgagcccaggagttcaagattacagtgagctgtgatcatgccactgtactcctgggcaacagagccagcccctgtcatcctccctgcatctgcccaccataattatgtattaatacatacccttcataatcctctctgtgaaatttatcctaaagaaacaattcaaaggaagaaacagtttgctacattaagaatattcattattttattatttatataacatcagaatattggaaaccaccctaaataaccaagcaggtagaaatcgtgaagtcattcgattcatttatgaattatgttcataatcaacacaatcaattctttcaaatgttttatttagaacatttgtatcaatgtttacttacatattttgtacccatttaaaatgataggaagtgggctgggcgtggtggttcacgcctgtaatcccagcactttgggaggccgaggtgggcggatcacctgaggtcgggagttcgagggccgcctgaccaacatggagaaaccctgtctctactaaaaatacaaaattagccaagtgtgatgacgcatgcctgtaatcacagctactcaggaggctgaggcaggagaatcgcttgaacctgagaggcagaggttgcggtgagccaagatcgcgccattgcactccatccagtctgggcaacaagagggaaactctgtctccaaaaaaaaaagataggaagttagttgtgttcttgcgaaaaattgtgtgtgtgtgttttgttttgttttttcgagatggagactcactctgttgcccaggctggagtgtattggcatgatctcggctcactgcagcccccacctcataggttcaagcagttctcctgctcagcgtcccgcgtagctgggactacagatctgcgccaccacacctggctaattttttgtatttttagtagagatggggcttcaccctggtggccaggctggtcttgaactactgacctcaagtgatccgcctgctttggcctcccaaagtgctaggatcacaggtgtgtgagccactgcacctggccaaaaagtgctttttgatatctgtccaaagctatatatttaatttgtgtccctgttatgattgaaacagtaaaaacaacattgaaaagaaactcaaaacttaatgactgtttgagacttactcactaaatatgtattgcattttaagaacctgactaatgcatcttatgaactttcaagaaataaatttttagaaacatttctcttaagttcacttacaaactatttaaaaatacataaaagactccagataaatcaaaagtagtttctcaaggtaaaatattctatctgtttcacaagtatttgttgaattagcttgtttttttttttttttttctgatttagctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatggggtgagcagcctgttgtttaataaactaataagagtattttgtttctagccccttccagcatatgtcatggaaagcactaaaaagaaggtgcaagtagcatggcaacccagttgttgctgttagtaggtattatttttagaccttgtctggggtattctgtgtgtgatctagtttttcctttttgtaatttgcttaagtccaacttcctcttctttttaatgtcaaaaataagcaaaaaataagttaggacaacttaaaattcatgaacaaaagagtagtaaaaataaacccaagcagcttgaaaataattaaaacatttctaaatttactagtgccttgggtctaagagcatctgactctaaagtggttgtgcaaaactgatgataagagtttaaccactttttaccatttggagataaggcttacctaataaattatttggtactctgggagactgaagaaatttgatcctttataggagtatgcttactatattattctggctttaaatctttattatctttgatataaaatcatttcccttctagaaacaaatggtttaaattttacatattttcctgtagagcaatattgcattaatagtgtaagtactccaaaatcttcctttgctatgcagtctttggtgctaggaattttataatctctcaagtcatacagtatcattgatcttttgtctggaggaaaaggaaaataatccattgagaaatttgattctctatgccaaacaagatggatttgttatatagaacctaaacgaagaaaatcaagccttaaggagctcaggagaaaatgccccctccatcaccatctcttcccctccactgccattggtatcatccctgttagaattcatcagagtaaaacagcacctttcgtattcctttcctaactaggcatagttttatcccttttcttcatattcttgtctattccttatacctcatcatcataatagcactcactgctgtagacaaattcacctttatcagcagccttccctttgttccttggttatgactcaggtacttttctttcatataacaattttttcctgccactttctctaaacagttgctaactatatttcccctcccagtggttttaaagctgaaatgaattttgtctcttgtgtactttacccttcttttcatttttttttctatgctgttttacatcttccttcctttctaaattataatcacctgtggtatgcctggccaaatttcttctaggtttgaatacctagcttgcctgccttctttaaaactagtttccacatgggtgttcagtggaaagagcatgggctttggagttagacacatctgggttcgaatcctggttccacagttactttctccatatgactttgagtaagttacttaacctcatcaagacttatttcctttatctgtaaaataaatacagatataaaattgcctcagagtttttctgaggattctttaaaataaagttccaatatatttggcatgtactgaatgcttagaaatgttagttcccatctcttctctccttcatattcacctctgtatatgtaccctttatctcatttttgcattacacaatctttcaaagcattcttttaaaagagagatttagcagatttctggagcaccaacggtgtgttttgactactgtaatcctgaccgatttagtactcagagtctttggaatttttttttttttttttaagtacagcttctccttcatcatcctgtccccccgcccaatccaatataatctgaacaattttctgaaatttttactctttgtacttgatgtggagtggtttgaaattacatagaatctaaacagcctattttagttaacatagccaaagatataagctgaagtgaattaatttaacatccttaataacatttactttaaaaatgatggggtgttgctgagaaatagtctgtttattgagtatatgaagtggcctttgtccaccattgttgttgtgactcttactagcatacagaaactgtcatacacccagcattttaagtctcagagtggatatggttgacagtaaaacactgtgaaatggttcttcctggtccatggcttaattgtgcatgtccctagtttatccgtccagggagagccagtggggttggcttcagtcttaaaattgtcagtacagtatgtcacgtgccaaacttttcagacctcatctgtaacttgggctcagaccttttgtagtgtttcccgctggcctccctgttctcacatcttctcataatcatgtctgtcaggaggagcaaggcagttctcgacagcactaaatccaagagttattatatcagtagtgtaatgtagctcatatcctttaaaacctcatcaatcaaccaggtttctgtagtaggccggtgacatggggttgtaggggtgggtaaagaaacaagaagagatagcaggggagctgctctatattgagatttaagagaaacaaccaaatgtaacgtaaggactttgtttgggtcctgattttaacaaataagcaatcatgcatttaattacagattaggtattggatgataaaattaacattgattctttaccacatgtcataatgacattgtgattatgtaagaaaatgtcagcctggcgcggtggctcacacctgtactcccagcactttgggaggccgaggcgggtggatcacgaacaaggtcaggagtttgaggccagcctgaccaacatggtgaaacccggtctctactaaaaatacaaaaagttagctgggcgtggtggcgcgtgcctgtgatcccagctactcaggaggctgaggcaggagaatcacttgaacctgggagccggaggctacagtgagccgagatcgtgccactgtactccagcctgggcgacagagtgagactccatctcaaaaaaaaaaagaaaagaaaatgtccacaaattttagagagacatactaaaatatgtagtagaggtgaaataatgtttgattttcgcttcaacaaagaacaggagaaaagagataaagaaacttggcaaagtcttgataagtgttgaatcctggtgctgggtatgtgggaatgtgggattcattgccctgttttacttgttttttttttcttccccatagtgaaattatttttaatgcagttagactcttgtttatcttactgaagaagaaagggtttaaccaaatcttactgggtgaccatgtaattatctctacttaattatacatttaaatcaaaacagacttaatatctctacacagagtcggtgtgacttttgttttctttttccaaaggttgactcttactttgctttcatcttatctagccaaatctttctctccaccaatgtgatcattggaaacagaacttttaagaagtcttccatacagttctaggctcattaacactttccagctggaaacctttccttccactcatctggcagcccactcttcctgttcccccaactctcttctcataattctttgtatgtcacatgttctgtatttgatcttctgtttttgagttacacatataatatttttcatagtcatatgatgattctgggtactggtattgtaaatgacttttgggggggttatatatttttctaatttttatattattgatgtaaaatttgtagcacaaaggaaaaatggtcattttggggatgaggattacatatatgtgtagtattttaattttaaataattttaaatgttaggtaatgtttgcaccggttttttttaaaccaaaccaaagtatattggcatttatccataaccatgtgacacttctttaagatacaaactctctgtgttatacattgccagggaagggaaatcagaactcataagcttgctgtcagataagttgttaagttgttaatagtttcatcactttttggttctttttagaatcaagatttatttgctacatcacaaagtaaagaatttgatcctcttggtccattgccacctggatggggtaagtcacatgagtttcttcatggagttctgtcatttcatttttgttctcttccaattgtgtcattttaaaacagatatttatgtctgatactgtgctcttgcttgagtgaatgtctgggaagtttttttttaatatatatatcagtttaattcacaaataggcattaaattccccaaacattaagtggactctttataaacttttattgacgctcataattattttactcttctacagtttaaagatactgatcacccagcaataaaaaaggaatgggctattgatacaccagtaggtctgggtggacttcaagagtaatttgcttgatgaagaaagtcagtctcaaaagatcacaacctgtgtgattcaattcatataacattctcaaaatgacaaaactagagatggagaacatattagtacttgtcaggaaacagggtaggtgggaagtggattcaaatattaaaaggtaacataagggggttttacgtgatgatgatgattccatcatcttgattccatcaagatccacaagatgattctgtatcttgattttggtaataggtgattacattaataatgtatacatgagataatgcatagaactatatatttacagaaatgaattcagcttttaaacatggtgaaaatttaacaatgtttgtggttaacaataatgtaccaatgccacttctgtggttttgatgctgtacgtagttatataagatgtcaccatcggagaaaaatgaagtatatgtgagactttttgtgcaattttttacatcctgtgagtaataattaattcaaaataaaaagctttttaaaaaattgtaatcacattggttctcctaaaacaaggttcagagtttggttaagttggcattatctgatagaagagtggaaggagcacatgtgaaggtgtcaacttcatgccctacaccatggagctcaagagcatgtgctgttattgagtatatctgataccttagttattaaaatagaccttaatagactttaagctggacctaccctactaggttctattttatagtgttatgtaatactcacagcattatatagcaaggtttcagaataaagatggcagtatagaaagttttgcatagaagcaagataataatatattataatagaaagtggaaaacaacataaagcccattgtggaaccagagttttgtcttcaagagctgaagatacttcataatattgggataaattcagaaagtgatatttctagattgggaaaagttggtccccaagatacattgttctagcagtactgagttatggagaaaaaatgttggtgtgtcaagatcacatgagtctggttaataaatgctactgggggtataagcttttctttgagaaatctcattgctcttatttaaaggtatctattctcaaaacacttctgtgagtcaaaaaggtaaaaaatgtattaggctatacatataactgttactgttattagcttataacaacaggaggacatatgaaagttgtgggcccgatgcagtgacttacacttataatcctaacactttaggaggctgaggcaggtgaatcgcttcagttcaggagttcaagaccagcctgaccaacatggtgaaaccctgtctctactaaaaatacaaaaaaattaggtgggcttggtggcccgtgcctgtaatcccagctgctcaggaggctgaggcaggagagtcacttgaacccgggaggcggaggttgcagtgagccaagatcgcgccattgcactccagcataggcgacagagcgagactccgtctcaaaaaaaaaaaaaaaaagaaattagccaggcatggtggtgcttgcctatagtcccagctactcttgaggctgacgtgggaggatcgcttgagcttgggagtttgaggcttcagagagtcgagatcacactattgcactccagcccgggtgagagagcaagaccctgtctcaaaaaaaagaagaaagcaagttgtgaatttctgtctttaccaaagcttggcagcctggagttaaggagtcctctgtctctactgaagcctaagagtggtcagtgaatggttagtatgaagtactttagaagaggggatgttgcccttacaaggcatattaaacttaacctgtcagattgcattcccagacatggatggttttatttctagagtttcccagctttatttctagagttgtatgtcttatgttagagaaggagaaaaaaactcatgcactaaaatgatatatccaaaggatatgtatttatcctcttaattttattgcaggccaggcatggtggctcacacctgtcatctcagcgctttgggaggctgaagtgggaacattgcttgagcccgggagttggagatcagcctgggcaacatagcgaaaacctgtctctataaaaaaatacaaaaaataatctgggtgtggtggaacacctcctaatcccagtttcttgggaggctgaggtgggaggatcacctgagcctgggaagtcaaggctgcaagtaggccaagattttgccactgtgcttcagcctgggcaacagagtgagaccctgtctcaaaaaaaaaaaaaaaaaaaaaaagttgcagaaaaactatgacctgcttcatggttatggtcagaaacaaaactgttttactccttctctagggcaggtgtagaaaaaaatgcctcttgcttatagaaagctgaattgtgagctgcgtttcctttatcagaaaagtctttcctgcaagttggtccttgccttctgtattcatcattttctttatcatccagatctttctcatttttactttagccaacaacactttgctaaaatactgtgttaaagatccagcttagccaggttattagagtcttgttctgctattttacagtctgcttatttttaggtttcacattcctcatgttgaagtagtgctacagatgtttatgattatcctactcagactgagcactgctttatgacttgctgcctttggggcatataccttacttgtagaaccagtgacagcactggtagtatatcagatgaagcaacccacccaacataccttcaggattgacccaggttgatagaatcccatcttacagcttgcaccctttcagacttttatatgctgggactagacattcctacctcataggctcagtgaataattggttttttagagatgggggtctccctgtgttgcccaggctggggtgcagtggctgttctccagcatagtaattgcacactacagctttgaactcctggcctcaagcaatgcctcagcctcctgagtagctggaattacagttttgtgccacgatgcctagctaggcagtgaagaatttttaacacatgaacatactatagaggataaagaacaaagaatacttttggttcaccagtattatttaatagggctttgtataggtgcttcgccaatcaagtatgaagatattctctcattttcctagttactgtgaaagaatacatagaatgacaagaagtgtctgttttttactgttttattcatcaagtcaggaagtgttctaatctgcatttggatttgatgttcagtaatttcagtattgtttattatgtgatttttcaacaaagtcagaaatccgttctacagccacagcacttcctctcattaagtagatgagccttcagttcacaaatgtgtcaaggctgatctcagcagcatatacttagaatatatatgagaaaaatgtttgctattaattttctcttgcctcatgttatcttctgaaaggaaaatcttggcctgaaatctgaactttgctgacagataaaagatgaatggccattacagtggctcacgcctgtaatcccagtactttgggaggccaaggcttgtgtccaggagttcgataccaggctggggcaacatggtgaaaccccatctttacaaaaaatacaaaaattagttgggtgtggcatgcctgtagttccagctacttgggtggctgaagtgggagggttgcttgagccccggaggtcaaggctatagtgcgctgtgattgtatcactgcactccagcctggacaacagagtgatactctttcaaaaaaccaaaagagagagaaaaaagttgagtatgtgctcagctatatacttagggtattatttttaggttataaaaattatttggatatatatttttaaacaagaaagagaattctggctgggtacggtggctcatgcctgtaattccagcactttgggaggtcgaggcgggtgaatcacctgaggtcaggagttcgtgatcagcctggccaacatggtgaaatgctgtctccacaaaaaatacaaaaattagctgggagtggtggtggacgtctgtagtaccagctatttgggaggctgaggcaggagaattgcttaaacctgagaggtcgaggctgcagtgagctgagatcgcgccactgcactccagtccagcctgggtgacagagcaaggctccgtctcaaaaaagaagaagaagaacaaagagagaattctggattctgcaaataaatttttaaaatttaatgcgactgccaagacatgaacttatcttgctgttatgttaacaagagcaagctgtaacactgtgggtgattatgtttttcttttttttttttttgagacggagtctcgctctgtcgcccaggctggagtgcagtggcgcgatctcggctcactgcaacctccgcctcccgggttcacgccattctcctgcctcagcctcccgagtagctgggactacaggcgcccgctaccacgcccggctaattttttgtatttttagtagagacggggtttcattgtgttagccaggatggtctcgatctcctgacctcgtgatccgcccgcctcggcctcccaaagtgctgggattacaggtgtgagccaccgcgcccggcctatgtttttctttagagacagcctttgagttggtgataagcttatgcactgaagatgccttgaccagcaaaacctgtgtcatgagaggcagagtcccacttttctgtatattatgcacattggaattctattttcattttaagctaagctgacatagaaagtagctttaaatgtcagaagcaggtttgtgatactcactagttacatccattttaacctctgttatcactactacttgaaatcatggaattatattggaaataaaattaaatattaccaaatacgaacttgacaagactataatttggcctaaaactgatccagatgatctcaagtgttaatttgaaaaatagttaccaatttttcttttttcttttcctgtttttttttttttttttttttttttttttgagatggagttttgctcttgtcgcccaggctggagtgcaatggcatgatcttggctcactgcaacctctgcctcccgggttcaagcgattctcctgcctcagtctccctagtagctgggattacagatgcccaccaccatgcccagctaatttttgtatttttagtagagacggggtttcgacctgttggccacgctggtctcaaactcgtgacctcaggccatccgcctgccttataactcccagagtcctgggattacaggcgtgagccacagcgcaggaccaatagttaaccaatttttcaaaccacaggaaataaaaattagccatgtcaacatggattaaacttaaatttttgtttaaaatgctgatttttagaaactaagctttttaaaaagtttcagttcattctatgatctttaatacatcagttcattctatgatctttaatacatcagttattcattttgagacatgttgaacaaataaattaggatacagcaggaatcccatcttttgaagaattcattggtaatgggacagagaagtcagtaattcaaaaacagcagaactgttaaaatttcaagtctacttaatttgtttactaaaagagaaaatgatatccacattttttttttttttttgagacggagtcttgctctgtcgccaggctgtaatccatctcggcacactgtaacctctgcgtcccgggttcaagcagttctcctgcctcagcctctcgagttgctgggactacaggtgcacaccgccatgcctggctaattttttttttttttcttttttgtattttagtagagacggggtttcaccatgttgcccaggttggtcttgaactcctgagctcaggcagtccgcccgcctctgcctcccaacgtgctagaattacaggcatgagctactgcgcccggccaatatccacatcttctaaaccttaatggggagatttcaggaaagcaggtaaaattttgtagactgggaacacgaaaacagggagaatcctaaagcaagaggcagttggggaacaagcagcagctttagatgcagtaattagagaactgagttctgcttcctatcccttgtatagaaagttactgtagatatttaggattttggaactgggtatattaaggaacgagatatgttaagtgtattaagaaaggaagtattttttagttgaataatgcctagcatataccttatattatattccttattttgtatatatatgtatgtatatatacacactctcaaattacattatattccttattttatatatatttttatatattgtgtgtgtgtgtgtgtgtgtgtgtgtatatatatatatatatatatatatatatattttttttttttttttttttttttttttgagacagggcctcactttgtcacccaggctagagtgcagtggcatgatctcagctcactgcagtcttgacctcccaggttcaggtgaccctcctgccttagccccggaagttgcttctctgtcccattaccaattaattcttcaaaagatgggactcttctggtatcctaatttttttatttgttcaacatgtctcaaaatgaataactgatgtattaaagatcacagaatggattcaaactttttaaaaagcttagtttctaaaaatcaagttgtacaagttgtggggctaaggcaggaggatcacctgaacctgggaggtcaaggctgtagtgagctgagatcacgccactgcactccagccagggtgacaaagtgagaccttgtctccaaaaaaaaaaatatatatatatatatgtgtgtgtgtgtgtatttatatatacaaatgtatatttaatatatatcaaatatatatattagtgggctgccagcacggcccactaatttttttgtattttttgtagagatgagggttcaccatatggcccaggctggtctcaaactcctgagctcaagcaatctacttgccttggcctcccaaagtgctgggattacaggcctgagccaccccgcctggcaccttactatattttaatgaatgaaatgatgtagtatggaaaaaaaaaaaatccctaaatggagacctgagtttccatctcatctctgctacttaattctgaggtttcaggtagattatttaacctatctgagttttcttatcttaaggataaagatgaattcacctaccctatgggactattaagaataaaatgaaggtcctgtgtaaaaaactaaataactgttcattattcttgctgctgttggttggattgagtagaaaggtcctatggttaggacattataaagtacgtctacttagcttctaagatgtaatatttctataacttcagtaaggatgtgcatttaatagtcaataaattaaaccttttaaagctgtgatttaaaaactataaaataaacaatgaaatgagaaatgggcaaattcaaataattttattttaccttgagcaagaagactatgccaatgctaatgctttgctttcccctgcccctgcccttcccaaagagaagagaacagacagcaatggcagagtatatttcgtcaaccacaacacacgaattacacaatgggaagaccccagaagtcaagggtaagaatagttacttgtgtatatttaatctcttaaagattataccttatttctaacaactgaagaagatcaaagttcatattcttttgccaaagacctaaaacgttaatcacctacatactttggaaagagaaaattatactattattttcatctaatggaaagtttgaagatttcttcaaagtgcaggaaaaaactttaactgggcatggtggctcatgcccattatcccagcactttgggaggccaaggagggaggattgtttgaggccaggaagacctgcgtaatgcagtgagaccctgtctctacaaaaaaaatccccaaaattgggtgtgttggcatgtatacctgtagtcccagctactcgggagactgaggtgggaggatcacctgagcccaggaagtcgagactgcagtgaactatgattgtgccagtacactccaacctggaggacaggttgagggctgtttcaaaaaaaaagaaaacaatagaaaagcaaaaaaaattatctggcacatgagaatatacttattaacatatatattatttttaattactaagaacagattagtgattctaaatcagggtttcttaacctgagatcactggttaagaatctagggtatgtggtttcaaggaggaagaaaatacatactcagtttcattactctttactggaaatttagtatcttcttccattatgaatgtaggctactaccatgtaggattaagaatgcctaggagtttgccatcagtagaagtcaaagggtgttaaaaaatattctgttgttgttgcagatatctctaaatacttgtttacacacataattacaaggacttgctaatttattaataaagagatatatgtacattatcacaaaggtctccctttgttgcccaggctgttctcaaactcctgtctttaagcgatcctcctgccttagcctcctgagtagctgggattacagaaataatgttttgacaattatgtatatataatggtttatctttgtaacatgttataatagtatgcatattagtttgctagggcgccttaacaaagtaccacagaggaggttgcttaaaccatagaaatgtatgtctcagggttctggaggctagaagcttgagatcacgatgtcagcagggccatgctcactcagaagatactaggaagagatctgttccaggtctttctcctggcttcttgtagctccttggcttgtggcagcatgaatccagtcttcacatggcactcttcctgtctgtatgtctatctgtacccaaatttcctgtttataaggacgtcagtcctataggattagtggcccacagtacttcagtatgacctcatcttgatacatctgcagtaactctgtttccaaataaggtcacattctgagttattgagggccaggatataaacgtgcatttggagggaggacacagttcaacccataacagtctgtaatactatgcatttatcagactgccagagggttccattctgcaaggaatttggcagactgtacagtcggagggcacagtcctccacaaaactgctgccctcacttcagacatcagcgacaatattgggggtccacaggatgactccagaccaactgtctacaaatttgggggcccccaccaccactcttaggtatgataagttactagaagtactgagaactcattgaaacctcttatagtcacatttattctagagaaagaatgcaaaataaaatcagcagaaggaataggtgcacagggcagagtctgggaggctctgaacatccagcattattgtgggacagtacacattgaggtcgagtatcaccaaccagggaagtctctggtatctagggtttttattggggcttgatcacgtactgccctcttggctgaccttttgtctccagtccttactggagatttgagctaatgccctttagtctctagttcctccagaggtcggaactgatgctccatgtcccacagccttgactgtccagtgatcaaagcctccaggcaaacaaagatattcccaatacgcagtgcattccaagggcctaaacatcactaccaagttgctgagggcaaaggccagacctctcttttggtataattataatttgagaacagatattccatggctcaaaagttttaaaaacttttgttctgaaggtatggtttaggttgcactgagctgagatcataccactgcattccagcttgggcgacagagtgtgactctgcctcaaaaaactaaaactaaaaataaataaaaaaagatatgctttcaacttaaaatagttttttctgcctaccaacaaatgaccattttctttttaaatggagttactgcatttacttaaatttattcagtttccataaaggaagaatgaagaatttcatagataacattttcttcctctttagaattttctaagaatagaattgaagaagtcacctttctataatttgctgccatttttttgtttcctcttagatgtttaaagttttatagctaaagttagaattctgctttaacaacacagatgacctagttctatctaatttattttcaagacaacaacttgttactgagcctatcttgcaagtataacaattgagaatcctcttttttacatttttggtagtctgttttatctgacatttgtattcagttaagtgaatacaggtttgttgttgttgttgttgttgttgtttgagacaaggtctcagtctgtcacccaggctggagtgaagtgacatgatcatggcttgctgcagccttgacctcctgggctcaagcaatcctcctgcctcagcctcccaagtagcttggactataggcatgggccaccacacccagctttttttttttttttttttttgggtagagacggtgtctctatgttgcccaggctggtgggaagttgttgccaaacacacaaactgaaatacttgattaaaagatgtcctggcagtatgtaggaaatacttttggaagacctaaagagaacgatcaatctatagttgtagtaggagtaataacaattacaacttgggctcactgtcactttttacctgtctcatttgttcctcatctagtctcatagacattgttgtctctgttttatggacaaagaacctaaagtttagagagattaagcagcttgtctagggtcacaagagttttcaaggtataaagataggtattaaggaggtggcatggaatacttcataaataacatattaggccttgtgtagtgtctcaacatctgtaatcccagtgctttgagaggccaaaataggaggatcacttccggtcaggagttcaagaccagcctggggaacatagtgagaccagtctctacataaaattttataatttaaccgggtgtggtggtatacaactgtagtcctagctactagggaggctgaggtgggaggattgcttgaacccaggagtttgaggctgcagtgaactatgatcatgccactgcactccaccctgggcagcagagtgagattctttctcttaaaagaatctttttttgagttgccttagtagaaaaacagtagatagataatatgggacaaaaggaaaggcttcatttggaggtgtggcagatcatatcttatttaaggaagtgctgagtggcctacactgtgaaatcatgggattcatgaaagggagttagaggtttgggtgcaaagggaacattgaggccagcgtatagaggctgagtgaatgccatatgaagaactttagatcttaatcattggtaatggtggaacagtgatagtactttacagagataactaatttaaataagatctctgttttaggatgatactctgttagcagtatcagtataagagcaggcctagagtgagatcagataaggaaaacgagttaggtggctgttcaaaaaatgcagaagatggctgggcgcagtggctcacgcctgtaattccagcaccttggaaggctgaggtgggaggatcacaaggtcaggagttcaaacccagcctggccaacatggtgaaaccctgtctctactaaaaatacaaaaattagctgggcgtgggcgtggtggcaggcgcctgtagtcccagctgaggctgaggcaggagaatcgcttgaacctgggaggtggaggttgcagtgagccaagatatcgtgcccctgcactccagcctgggcgacagtgagactccatctataaaaaaaaaaaaaaaaaaaaaaaagcaggagagaaacaaagccagagaaaggatggtgttggggattggaaatagagatgaacgtgaagatttctaaggcagaatggttagaacttggttaacaaaatgtttaggatgagtcattagctaatggggaacataagccaagtagacggcagaagacttgagttgtgtttgatggactttgagtttaacctgtttgtaggatgtccacatagagatgtctagtatacaactgaattactgaactgaatggttttctaaaagatttctgctatgtttattgacatttgtagcttctgtacttggcaaacaagcaactctttaatatttttgtttatgttttttcctgtgtttcgtagtcaattaaatgaaaagcccttacctgaaggttgggaaatgagattcacagtggatggaattccatattttgtggaccacaatagaagaactaccacctatatagatccccgcacaggaaaatctgccctgtaagttttctaaacattgtagattaagagtaaaatactagtccttcagattttgatataaagatttgtattagcaaggagtggaagtcttagtatttcttgagttagcttgacaataggtttctgttcattaagtattttgcatttccatctccctcttggatattttatcctagagattttcatatttgttaccatttgttcacacagcactaaatgaaactatttagaatttataggtattgtactgcttaccaattagtctctgatttctgattttcagcttctttcattcccttaactttttgacgttaaaaaagctctcattacttatcccccaccccatttctgagaaagtaaccttttgatttgcttatgtgctttatgacttcttttgtgggaaaatatataacctaaagtttcttgttttatgtgtacagttcagtggcattaagcacattcatattgtggcataatcattaccaccatccatctccagaatgttttcatcattccacactgaaacactgtaccctttaaacaataactttagcagacctggtaaccagccttctactgtctttctctatgaatttgactagtcgaagtacctcatattattggagtcatacaatatttatgcttatgtttctggattatttcactaaggtcatatcttcaagatttatccgtgttgtaatatgtatcaacattttcattccttattgaagctgaataatattccagtgtatgtatatatcacattttgtttattcacagatatttgcattgtttctgttttttggggggtattgtaaataatgctgctctgaacattggtatataattttctgcttgaggccgggcgcagtggctcatgcctgtaatcccagcgctttgggaggccaaggcaggcggatcacctgatatcaggagttggagaccagtctggtcaacatggcaaaaccccatctctactaaaaatacaaaaattagctgggcatggtggcgcacacctgtaatcccggctactcgggagtgtgaggcaggagaatcgcttgaacccaggaggcagaggttgcagtgagtcaagatcatgccacagcactccagcctgggtgacagagtgagactccgtctcaaaaaaacaccaaaaaccaagtatctgtttgagttcctacttcgatgacttttgtatctgtacccaaaagttagggttagggttagggttaggatgacttttgtatctattgctggattaaatattaattctgtatttaattttttgaagaaccaccatactgtttttcagtgtctgtgccagtttacatttccaccctagtgcagaagaattccaatttctgtacgttctcatcaactcttctgttttttttttcttcatcatcatcatatttttttttaaatagtcatccttaatgtcgtatttcattgtggtttttctttgtatttttctaatggtttgtgatgttgagtatcttttcatatgcttcttggctatttgtgtatcttctttggaaaaatgtctcttcaagtcctttgcccatttgttgttgttttttttttcttttgcgattgagttttaggtgttctctatatattctgggtgttaatcccttatcaaatacatgatttgcaattattttctcccattctgtggtttcctttttactgtagatagtgccctttgatgtataaaacattttagattttgatgtctgatttgtcaattttttcttttcttttcttttttgagacagtctctctctctgtcacccaggctggagtgcagtggcacaatctcggctcactgcaagctatgcctcccgggttcacgccattctcctgcctcagcctccgaagtagctgggcctacaggcgcccgccaccatgcccagctaatttttttttttttttttgtattttgtttaatagagacggggtttcaccacattagccaggatggtcttgatctcctgacctcgtgatccacccacctcagtctcccaaagtgctgggattacaggcgtgagccaccgtgcccggcctgttttttctttttttttttttctttctttctttcttttttttttttgagacggagcttcactctttttgcccactctttttgcccaggagtgcaatggtgcgatctcggctcaccacaacttctgcctcctgggttcaagctattctcctgcttcagcctcccgagtcgctgggattataggcatgcaccaccacgctgagctaattttgtatttttagtagaagacagggtttctccttgttggtcaggctgatctcgaactcccgacctcaggtgatccgcccgcctcagcctcctgaagtgttgggattacagatgtgaagctccgcgcccagcctgtcagttttttctttgtcacctgtacctttggtgtcatatccaagaaatcatttccaaatccagtgtcataaagctttgccctaagttctttttttttttgtagatagagtctcactctgtcgcccaggctggagtgcagtggcaagatctcagctcactgcaacctctaccgcctgggttgaagcgattcttttgcctcagcctcctgagtagctggggttttagctacgcaccaacacgcctggctaattttcgtatttttagtagagacggggtttcaccatgttggtcaggctggtctcaaactcctgacctcgtgatccacaccccctcagcctcccaaagagtagggattacaggcatgagccaccgcgcctggcctgagagttctttaattttagctcttacatttagatcttttatccattttaagttaaattttgtatatggtgttgggtaagggtccaacttcatctttttgaatgtgaatgtccaattttcccaagcaccatttgttgaaaagactgtcctttccccattgcatgactgtggcaccattgtcaatagcattttaccatatatgcaagggattatttctgggctgtttattctgttggtctgtatgtctgatttgccaataccacgctatagctttgtagcaagttttcaaatcaggaaggtatgtgtcctccaactttgttctttttttcaagctgcttttgactattcagggtcctttgagattccatatgaattttaggatggatttttttatttctgaaaaaaagaagtcatttggattttgataggggattttattgaatgtacagaatcaataaaatccatattgatcaatacagattcaatatctgtatcaatctggggtagtgtggtcatcttaacaatattaagtcttccaatccatgaatgtggatatctttgtgttttctttgatttctttcagcagtgttttgtggttttcagtgtacgagtcttttgccttcttgattaattcctaagtattttttattctttgtgatgctattgtaaatggaattgttatcttaattttctttttatattgtttattcttagtatatagaaatggaactattttgtgttgactttgtatgctgctactttcctgaattcacttactctggcagggtttttcgttgtggaatatttagtgttttcttcgtaaaagatcttagcttctgaaaacagataagttttcttcttcccaatttgggtatcttttatttatttatttatttttcttgcttaattcctctggctagagcttctggatactatgttgactacaagtggtgaaaataggcattcttatattgttcctcatcttaaagaaaaaacttctaaccattgaatgtgatgtttgctgttagatttttatatgtgccttttattatattgaggtagtttccctctattcctagtgtttcctatccctgttgtggagtgttttatcatgaaagtgtattaaattttgtaaaatccttttttggtatcaattgagatgatcatgtgattttttccccccctcattctgttaatgtggtatattatgttgatttttcataggttgaaccttttttgcattccaggaataaatcctacttagtcaaaaggattaaagtgtgcttttaatatgctgctgagatttttttgctgatttttttttagtatttttccatcagtgttcataaggaatgttgctctgtagttttcttatagtgtggctttcttagagcaaagatggttccctattactttctaattttatacttctacacattaacaacttttatatttaaagcagaaactggaaaatcaggccaatttggtattaatgaaattacagaggtaatttagatatgggaataaattaccgataatattattctatcattcattttagttacaataagtttgggtgcatataatagaaaacactaaaataatagtggtttatgtaagatagaagtgtatttgtccccattatttaaaaatagtccagcaggacttacaccacatcattaccattgctcaaaaaagaagttacaagaaaaatcaggaaatattttattttgaataataattaaaacaccacatatcacaatttgtgggatttaactaaagtagtcttcagcgggaaacttttgttttaaagaagtagatgagaatataggaaagataaaatcagtgatctctgcttttacattcagatgctagaaaaaggcaagttattaaacctaaagtaagtacaagaaaggaaataaataaaagcagaactcagtgaagtggaaaagaaacaatggagcgcccaaagctagaagataaatttttggtaaacattaataatattaacaacccttagtaattaaacctatagagaaaaaaagagggacatcactgtatattttatagacattaaaaggataataaagggtatatttatgccaataactttaacattttagatcaaatggacaaattctttgaaagatatgtcaccaaaatggacacaagaacagatagtaagtctaaatatccctatagctgataaatcaaatgcataattaaataatttttaagggcaggcccagtggctcatgccagtaatctcagcactttgggaggccaaggtgggcagatcacttgagctcaagagttcaagaccagcctaggcaacatggtgaaacccatgtctacaaaaaatacaaaatattagctgggtgtggtggtgcatgcctgtagtcccagttacttaggagggtgagatgggaagattgcttgagcccaggaagctgtggtgaaccgagatcgcgccactgtacttgagcctgggtggcagagtgtgaccctgtctcaaaaaaaaaaaaaaagaaaaaaaagatttctcatgaagaaaattctggcctagatggtgtcactggtaaggttcatcaaacttataagttataaattaatcagtcctattcaaattcattcataaaatacaagtgatggaaatgttttctttttcattttttttttttttttttttttttgagacggagtttcactcttgttgcccaggctggagtgcaatagcccaatctcggctcaccgcaacctcggcctccctggttcaagcaattctcctgcctcagcctcctgattagctgggattataggcatgcgccaccatgcctggctaattttgtatttttagtagagatgaggtttcaggccactgcattccaccctgggtgacagagtgacattccatgtcaaaacaaacaaaattggttaaaggagaaaaatcatacgataatttcaggaaaagcttgtgacataatacaatgcaaatttatgagaaactctcagctaccttggaaacttttttttttttttttttgagacggagtctcactttgtcgcccaggctggagtgcagtggcacaatctcagctcactgcaagctctgcctcccgggttcacgccattctcttgccttagcctcctgagtagctgggactacagacgcccgccaccacacctggctaattttttgtatttttagtagagacggggtttcactgtgttagccaggatgttctcaatctcctgacctcatgatccacctgccttggcctcccaaagtgctgggattacaggcgtgagctgctgcgccctgccggaaacatttttattggaaaaaaaaaatgtaacaaaagcttacagccaacatcacaattaatgatgaaataccgtagaacatcaagagtaagacaaggatatctactgtcattacttcattcaacattgtgtcagtattcctacccagtgcagtgagatgagaaaaagaaatacaggccgggcatggtggctcacgcctgtaatcccagcactttgggaggcccaggcaggcagatcacttgaggccaggagtttgagaccagcctggccaacatggctaaaccccgtctctactaaaaatacaaaaattagtcagtcatggtggtgggcacctgtaatcccagctactcaggaggcggaggcaggagaatcgcttgaacctctgggtcagaggttacagtgagcagagattgcgccactgcactccagcctgggagacagagcaagactccatctcaaaaaaaaaaagaaagaaaagaaaagaaatataagatgtataaattggaaaggaagaagtaaaactgtctcttttcccctcacacaaataacgtttgtatacagaaaatcatgaagaatctagaaaaaattactagaactagtaagtgaatttaacagcgtaacagaatataaagtcaatgtacaaaatcagttgtatttctacactgatatacattgaatttttaagagggagataatgcagtggtattaagtccaaggctagctgagaaaccccatggtgtcatagtgatctaaaattcttctgtcttttctaccatcctagagtatggtctcattcttcaaagtgacctcatggtctgtgacagctgctgaaacttaagctatcagggtcacactccaggctggaatttggaggaagggcaaattataaacacacacacacacacacacacacacactcacacactttttagctattttagctgtcttttagaaaatccttcctttttttttttagacggagtctagctttgtcacccttgctggagtgcagtggtgcaatctcagctcactgcagccttgacctctgaggttcaagtgattctcctgcctcagcctcccaagtagatgggattagaggcacctgccaccacacccggctaatttttataatttttagtagagacagagtttcaacatgttggtcaggctggtctcaaactcctgacctcagatgatccacccgcctcagcctcccaaagtgctgggatttataggtgtgaaccactgcacctggccaaaaagatccttcttgaacgtttcatatgccactttcacttagagacttaagtcacatggccatatagagaaatgtagtctttattatatgtagcattctacttagttaaatagcaagggttttacttaaagataaaggagggaattgatgttgggatagacagcattctcagatagaaacccctttacttagccctcttagatttggcagcatagaaaagaaaatcccacaacagtagtttcaacaaaatcaaagttttttgtttgttttttctgttacttaaaagtattcttggggaaatatctctcaaaaagcaaagaatggttttgttaggaatatgctatatttttgaatttggttagtaagtgctgagagagggtgggatattttgctttccttcagcattatcttttacaagcagctatatatgtcctgttaacccttgttcttcctcagagacaatggacctcagatagcctatgttcgggacttcaaagcaaaggttcagtatttccggttctggtgtcaggttagtattggaactgtatctctgtactgccttaactttgttgtgttgctttatattacacagtgattgtgaaaatacttaactcacagaaaaacaggtaaaatgggaagcattagaatctctttcatctatttttagagcaaataaatagatttatcaattagatcatttgtgactttggttattcagaaaattaaacctcatgtaatcccagcacttggggaggccgaggtgggcagatcacttgagctcaggagttcaggaccagtctgggcaacatattgaggccttacctctgtaaatatatatatatatatatttcttttttttaaagaagaaaattaaacttgaaaccatctgaataagcaaacattgtcactttttcctcagtagccattactttcagattgcaggaatcttcaaatgtaagtaaaagcattttctgatataattttaaccagctactttatttttatgtgttattttttctgagacaggatctcactctgtcacccaggctggagtgcagtggtgccatcatggcttactgcagccttgacctcctgggctcaagtgatcctcttgcctcagccttctcgctagctgacactacagatgcacttcaccacacctggctaatttttagtagagacagggtccccttatgttgcccaggctggttttgaactcctggattcaaatgatcctcctgcctcatcttccccaagtgctgggattacaggcataaaccagcatgcccggacaccagccatttttatatctatcgtttgatataactgactttgatagataaatacatgttcatacatacatgaacatgtccatacatagatgttatattcagtgtttttttcagatgtgatcaactatttcttatgtatagatatttactggaattaatgattttttatgggttctaaatcaaatgaatgccctagtcaaagttactgtgatgaatatttttacacttgaaactcttgtaattaactggacccatggaagcaagaagaatctggattaactgttggaaaataagattaagtaaagatttatttgacacattattaagtaagcagtgtgcatatgagatcaatcttgtggttcttctgtttgcatatattaatctgtaattagcatgaatactcacagatgcattggtaaacattattgaatataaatttatattcatagtctacttgtttctgtaaggaaagataaaagtaaataaaactttccccttttgatttttttgataggctattttaatgatgagagttgacttaagtcattcttctatttcagcaactggccatgccacagcacataaagattacagtgacaagaaaaacattgtttgaggattcctttcaacaggtactgtttcattctctcaataatttcccccctggctgctagcttaggacccgcttttggtgctgtcagtttaatctgaatggtttggaacttcttgagttgaagtccttgaatttttcaagtgcgatctcattgccagccaccttagggcttaaggggtgtgtgtgtgtgtgtgtgtgtgtgtgtgtgtgtgtgtgtgtttcaggtttccatttctaaactggtatgatttgaaataaatgcataggtaagataataggtttgtgtgtgtgtgtgtgtgtttcaggtttccatttctaaactggtatgatttgaaataaatgcataggtaagataataggtttttggtagccaaaggtctggaaatacccatatgaacattatcagattgtagaaaggagaggggaagacttgttttaacacttcagtattacttggatttttacaataagcgtatgttactcttaacaggaaaaaaagtggtcattggtgacagtatctaaaaaaagatatatatgagttttcagaagtagtcagcagattttttcacttgtcttcagaacttgagttaatttactcgctgggcacggtggctcatgcctgtaatcccagcactttgggaggctgaggcgggtacatcacctgaggtcaggagtttgagaccagcctggccaagatggtgaaaccttgtctctattaaaaatataaaaattagctgggcctggtggctgatgcctgtaatcctgtaaagctactcaggagagtcacctgaacctgggaggtggaggttgcagtgacccgagatcgtgccattgcattccagcctgggcaataagagcaaaactccatctcaatttaaaaaaaaaaaaaaaaaaaaaaaaacttgagttagtctactattcgcctttatcttgcagatattactaataacctactgcaactaaatgttaaaatgattgtgttatgtagaagattaaaataactagtgaaaaaatgtcttaaaatgaaaacatctggttagtccttgttttatagccagatgtggaagtgattattttcaagcaccagtggtattgtagcaactacagcttcaagaagtacggaattgaatgcaaagggaaaagaggttgagacagttggtggtagctggctacttgctttcagaatcagtttttttcatttcctaatggaacgtcagttattgacattaaaggaaaaagccagttggcatcctgctatgtaggagcagaaaactttttagtgggaagtggagctttactgaggccatttagagaattatgagtcatccccttgatctgatgtaagtgtcacaggccattccccaccctagtccttgcccatttctaattttatgttcataaccacccttttatcactctgttggacgagtttcttgaagcaacttgcttacctcttaccagtcctggaaagatgcaaaacatgattaaactgttcctttatcttttgactttgaaacctaaagtcttttgcaaaataactgactagatggttctaaaacagtttttaaagctgtcaccctagatttgacatccatcaaataactggttaataaaaatataagagaacaatttgattgcttaaaggtaacaaaactaattgcaaaattagcatcagattttctttggatagttgttggataaaattgctctgggatagtgtttcttctgttaacacagcacaactggttatgggggaaagtacaggagaaaacaattttttttccttcatattagacatttgttaaaaggaatttttttttaacttttatggatttatttatagtaaagataaggatacaaatgtcttccacacatatgtggtaatctgtggtgctcgccactccctccctcctgggactgacacactgcagcccacgctgctcaccctggagccccatccttgcatgagagaatggcgccacctggggctgtgcgacctgtcagcctgctcattcccttctccagctcaggacagagaaacacaattcattcataaggtttccattctgttataggcagagatttagaaatcagcattgtttttcaaagagtacaaagttaaaccattctgcttagaaaagaataaacccatccaatcatttttcctctagttgagtcaaaacagagatcaaacttctttgatagtgttatgtctgtgttcagacttagacttcagaatcaaaattttgaaatatttatgaggttaataactatctttgaagttaagcagtttactgagcaattaaatatttttgtccatacacattcagatttaactactgctataaattgtcgtaatttctccagtttcagtctgaacataatagcttatagtaataagacacaggttctagtacagattttccaattagtggtatggccctaaacaagccaggttagatctctgccttcacctacatcaaacaggaataataatatatttccttaacctatcttctaggtaaacagatgagattatatgaaaacattttgctaaagtcgctaaacaaacataagaaaaaatatgtaaggtttttctatcacattaactattttttaatatctgactgacatttttgtaatataaccaaaataaaaattgcatactttcttttttttttcttttattgatcattcttgggtgtttctcgcagagggggatttggcagggtcataggacaatagtggagggaaggtcagcagataaacaagtgaacaaaggtccctagttctcctaggcagaggaccctgcggccttccgcagtgtttgtgtccctgggtacttgagattagggagtggtgatgactcttaacgagcatgctgtcttcaagcatctgtttaacaaagcacatcttgcaccgcccttaatccatttaaccatgagtggacgcagcacatgtttcagagagcacagggttgggggtaaggtcacagatcaacaggatcccaaggcagaagaattattcttagtacagaacaaaatgaaaagtctcccatgtatacttctttctgcacagacacggcaaccatccgatttctcaatcctttacccacccttccccgctttctattccacaaaaccgccattgtcatcatggcccgttctcaatgagctgttgggtacacctcccagacggggtggtggcctggcagaggggctcctcacttcccagtaggggcggccgggcagaggcaccccgcacctccaggacagggcggctggccgggcgggggggctgacccccccacctccctcccggacagggtggctgccgggtggagacgctcctcacttcccagacggggcggctgccgggcggaggggctcctcacttctcagacggggcggttgccaggcagagggtctcctcacttctcagacggggtggctgggcagagatgctcctcacctcccagacggggtcgcggctgggcagaggcgctcctcacatcccagacggggcggcggggcagaggcgctccccacatcccagaccatgggcggccgggcagagacgctcctcacttcctagatgtgatggcggccgggaagaggcgctcctcactcctagatgggatggcggccgggcagagacgctcctcactttccagactgggcagccaggcagaggggctcctcacatcccagacgatgggcggccaggcagagatgctcctcacttcccagacgtggtggcggccgggcagaggctgcaatctcggcactttgggaggccaaggcaggcggctgggaggtggaggttgtagctagccgagatcacgccactgcactccagcctgggcaccattgagcactgagtgaacgagactccgtctgcaatcccggcacctcgggaggccaaggctggcggatcactcgcggttaggagctggagaccggcccggccaacacatcgaaatcccgtctccaccaaaaaaatacgaaaaccagtcaggcgtggcggcgcgtgcctgcaatcgtaggcactgggcaggctgaggcaggagaatcaggcagggaggttgcagtgagccgagatggcagcagtacagtccagcttcggctcggcatcagagggagaccgtggaaagagagggagagcgagaccgtggggagagggagacgggagaggcagaggcaggggcaggggcaggggcaggggcaggggcaggcagaggcaggcagaggcagaggcagagctgcatactttcaagaatgacaaaatttagtagttatacaaggtgaattaaaatagtaaagctagtcataatacagaatccactcatccatgtactcattttatcacttaaataataattataaaaataggtaaaattccatgaaaatattcctatttgttctagttcaggaggtcttgcccacatcaatggattgtctggcatcagccactgtttcaggcactcgaacagtcatattgtccatagattttgtcaaacagatttggcagcccaactgtgatctgttagtccatatgccagatcgagcatgtgattctcctcatcagtgattgcatctaacttctcatatatgtgatcttcaaagatgagatgacaggttaaacaagccagagttccctcacatgcaccaaagccatcaatatctggattattttcaaccacaacgtctagcagagaatcaccaacttttcctttggttgttaatgtttcaccatcacagtttataaagtggactgtcactttatcttctgagctgctccgcgcccctgccgacacgctcagcggccggctcgcctccgcgctccggcccggtccccggctcctcagcaggccgctggctccagcgcgggacccggcgtggtgcagccaccggccggccgggtcgccgaggaccgcagaagcggcgcgcagcagccgggcgcccccagcggcagccatcgcccgcggtcgggaactcaaaaggaattatttaaagatagttttaaccttgtgacatttctcatttgcgttgctgtatacctagcctatactatttgtagaatacttggcataaacgtacatatgtcataagcattgaagttttttgttacatctgggattttctggcttgagtgggatgtgaattcataaatgtgatggttttgtgggggaactgagagaacttggcataaacaggtatacttactgatcctctctggatatttaagtgtggtaattcattcttatcactcaataaagtataggcattatatcaacttctccctttccatgttcttctgtatttttttgtaagagtaattgatatatgcagtgctatacacacacaattttggtcaaataatttgttttacgtggcaggaaaccaaatgacctattgattgtagctcagtaatgtactgtccttcaaatatgaagatgatcctattaaccacctatagtgggacacaaaatttgagtagtttttgtaggtagttatcggttgccgctgagaatgagtttccaaagttaactgggtctctctgcagctactggttttcatttctcggttagccagttagctgttacgtgtacctttggctatgagtcaaaaccaaacctaataaccaaaccacaaaaaccccacccaacctctgaccatgcccatctatgttctaagtaattgatacaggcaacattataagtcaatagtagcatcattaaaaataaaatcacggccgggcatgatggctcacgtctgtaatcccagcactttgggaggccaaggccggtggatcacctgaggtcaggagtttgagaccagcctggccaacatggcaaaaccccgtctctactaaaaatacaaaattagccgggcgtggtggcgcacacctgtagttccagctacttgggaggctaaggcaagagaatcgcttgaacctgggaggtggaggtgtggtaagccgagattgtgccattgcactccagcctgggcaacgagggagagactgtctaaaagtaaataaataaataaaatcacgtgtataaggtatataaaaatatagatgtatataataaaatattattaaacgttactataatgtattttctgtatgtgtggttttgactagaccatgaacacctttctgtgtcatgggagatttcagttacctataacgaaggagatgtcaaacctagaagtggtagacagtgtttcaatagcttttttcaccaattattttactttatttttttttagataatgagcttcagtccccaagatctgcgaagacgtttgtgggtgatttttccaggagaagaaggtttagattatggaggtgtagcaaggtagtgataatatgaatactcagaacttagttcctttcctccaaaggtaccattgcacttcgcttgcaagtattattttctcaatcttatattttaggaaaatgaaatatgtcaaattattatacctttattatgctgtagctacagaatttcaaaaaacatttaattcagcactttctatgtcatgtacagctgattgatttcacccacatcactcatttaatcttcagggtaaccttgtgatacagaattttataggatgatgaagaggcttagagactcacctaaggcacataataaattgtagagcctggatgcaagctttgtatcatttaaccagtagccagtgttaagtctaccacctcttatatctgttccacagaaaacacaaggccttatagtgatcaggtcattttccccaccacagattactgatacaggtaatagttactcagtttccaactgagattagtatatttgtcatgaaaatatagaaggttgtacaaaataggagttgaaagtcttaattctgctttcttcatattggagcttaatattggaccctagaagatagtctctaatgagaattgctttgcttattccatgataatatatcacaccaggttaaaaatttgcgtagagctggcattgtgcaaagacaaggactttggggtcaagacgggatttgaatctttttctgctctcaatagtgtgatgttgggcaaatattttcatctgtaaaataagaatattaatatctacatttctaggattattgtgaagagtagaaatattgtttattaatgacctagttcagagcctgtgtctttgtgtgcacgctaattggtggctacattttagtagttcttatttatattatgtttctgagtttaaataaaattatttcaaaatatatgatataatcatagataaataacaaatatgagtagaaacatgtaattttgtataagttaaaggcaattgaagaggagagcaatcattcattcctaataagaaaataaactagcaatattaaagtgtgtcatgagatacacttatcacaagaggccatgaactaacaggaaaagagatccagattacaggcttatgccacatgtattaccccagatcacccatgttacgtagttttagtaaccataatcttatgttaatattggttcatattttcacaatatttgacttagagtctcagcatttttctaatatgtgagtggctggaattaagaactttactgcctctgtgaaattggaagaattttcatattgatttaacgtgtagggagtagtggcacttgatggggattattatgggacttagtaatagatggaatattagattgatttcagccactttactcacatgggtaaatagtgaattttaaatttgcctatgaatagtatttcattgattctaagactaatattttcattttataatatctctgaaattacgatgtatctcaggtaaaattggaaaatacaatttagtcgttcatcaaataaaggtgcaatgttgtcttagattttttgaaatgtaataatgtatatattaccatctaccaaagatggtgtatactaccaactctgtgaaacagatgtgagtttgaacagaagcaataaaaatcaacatgagattagaaaactatcactagctgaggggtatagatccctgagaactttatagcactgttctttgatttcttggtaacctacaagatttttcatcgtaaattttcttttgatttcagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggtaagtgcaggtcaagaattatgtttactttgcttattcagcaatactaaattttctcttaggtgccataacagatcatatgagagaaagggaagtggttttttgttttgttttgttttttatttttgagacagagtcttgctctgtcacccaggctggagtacagtgacacgatcttggctcactgcaacctctgcttcctggactcagtcagttctcccgcctcagcctcccaagtagctaggattacaggtgtgcgccaccatgcctggctaatttttgtatttttagtagagaaggggttttgctatgttggccaggctggtcttgaactcctgacctcaggtaatccacctgcctcagccttccaaagtgctgggattacaggtataagtcaccgtgcccagccagggaagtgtttttttgagacaaagtttcacttttgttgcccaggctagagtgcaatggcgtgatctcggcccaccacaacctctgcctcccaggttcgagcaattctcctgcctcagcctcccgagtagctgggattacaaacaagcatgtgccaccatgtccggctaatttttgtgtttttagtagagatggggtttctccatgttggtcagtctggtctcgaactcctgacctcaggtgatccacccacctcggcctcccagattgctgggattacaggcgtgagccaccatgcctgacccagggaagtgtttttaaatgaagagtacatctaatatattgaaataaaatgattattgtacagttattttaagcggtcttgtttccttttttcataggctctgttccatgggaaattcatagacacgggtttttctttaccattctataagcgtatcttgaacaaaccagttggactcaaggatttagaatctattgatccagaattttacaattctctcatctgggttaagtaagtttctttttccatgtaatttattaaaatatagttatatgcattccgtgtagtattgataacttatccaaactgtaggcacataattggtttattgtatttaaatgatctatatatcaaacctgtctttttattcaatatgataaattttacaaaaatacacccaagatcttcggcaataatatgaccttagaacagaatcttatttcttcttattttgatgttatagcttaatattaattatttaagaacatgggcctttcgttaaaaacttataaattatgattgaattggtggatataacaaatagtgctaatttcatttgtgcagggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcaggtgagagtgctccttttcacatttcactttttgtttgactacagcacattgataattgcttactaatactaatggagagtatctccaaaaatagtatttgtctctgtactaatcaatatcctatgtaggcagtcatttttcatttctaaaaagtttttttttaagtgtttttaaaagagttttaaggataaaagtcatgcaggatcactcttttaaacatcaactctgtaatcactatgctgtataacatgtcattaaaaagaatctcaaatatatatgcagatattttcatggggaatattgtaaggtgtattaatccactttcctgctgctgataaagacatatccaagactgggcaatttataaaaaaaagaggtttaatggacttacagttccacgagggtggggaggcctcaccctcatggtggaaggcaaggaggggcaagtcacatcttacatggatggcagcaggcaaagagagagcttgtacagggaaaactcctgtttttaaaacctcatcatcggccaggcatggtggctcatgcctgtaatcctagcactttggaaggccaaggcaggcagatcacaaggtcaggagattgagaccatcctggccaacatggtgaaaccccatctctactaaaaatacaaaaattagctgggtgtggtggcatgtgcctgtaatcccagctactagggaggctgaggcaggagaatggcttgaacctgggaggcggggattgcagtgagccaggatagcaccactgcactccagcctggtaacagagcaagactctgtctcaaaacaaacaaacgaatgaacaaaacacttcatcatatcttgtgagacatattcactgtcatgcaaacagcaggggaaagacccacccccgtgatcccatgattcagttatctcactgattctctcttacaacacatgggaattatgggagctacaaggtgagatttgggtgaggacacagagccaaaccatatcattctgcccctagcccctcccaaatctcatgtcttcacatttcaaaaccaatcatgccttctcaacagtccccaaagtcttaacttatttcagcattaactcaaaagtccacagtccaaagtctcatctgggacaagggaagtcccttccgcctatgagcctgtaaaattaaaagcaacttagttacttcctacatacactcagggatacaggcattgggtaaatacagccattcaagatgggagaaattggccaaaacaaaggagctacaggccccatgcaagtttgaaatccagcagggcagtcaaatcttcaagttccaaaatgatctcttttgactccatgtctcatatgcaagtcaccctgatgtaagaggtggcctcccatggccttgggcaacactgcccttggggctttgcagggtatagccccccaccggctgctttcatgggctggcgttgagtgtctatggcttttccagtctcatgctgcaagctgttggtggatctaccattctggggtctagaggacggttgccctcttctcacagctccactaggcagtgccccagtagggactctgtatgggcctccaacttcacatttcccctccacactgacctagcagaggttctctgtgagtgccctgcccctgcaagcagacttttgcctgggcatctaggcatttccatacgtcttctgaaatctagagggaggttcccaagcctcaatttttgccttctgtgcaccctcaggctcaacagcacgtggaagctgccaactcctggggcttccaccttctgaagcaacaacccgggctgtaccttggccacttttagtcatgctggagcagctaggaaacagggcaccaagtccctagagtgcacacagcgtggggaccctgggcccggcccatgaaaccatttttagctcctaggcctgcctacaggcttgtgataggaggggcttccatgaagacctctgacgtgccctgtagacattttccacattgtcttggggattaacattcgggtcctcattacttatgcaaatttctgtagccagcttgaatttctcctcagaaaatgagattttcttgtctattgcattgttgggctgcaaattttccaaacttttatgctctgcttcccttacaaaactgaatgcctttaacagcacgcaagtctcctcttgaatgctttgctacgtagaaatttattccaccagataccctaaatcatctctctcaagtacaatcgtctctctcaagtacaaatccaccagtctctagcacaggggcaaaatgctgccagtctctttgctaaaacatacaaagagtcacctttgctgcatttcccaaaaagtttctcatttccatctgagaacacctcagcctggactttattgtccatattgctgtcagcattttggtcaaagccattcaacaagtctataggaagttccaaactttcccacattttcctgtcttcttctgagccctccaaactgttccaacgtctgcctgttacccagttctaaagttgcatccacattttcagttatcttcagcagcaccccactcctggtaacaatttactgttttcacactgctgctaagacatacttgagagtggacaatttacaaaagaaagaggtttaatggacttacagttccacatggctggggaggcctcacaatcatggtggaaggcaaggaggagcaaggcatgtcttacatgaatggcagccggcaaagagagagcttgtgctgggaaactcccattttaaaaccatcagatcttgtgagacttattcactataatgagaacaacatgagaaaggcccgcccccatgattcagttatctcccactggttctctcccataacacataggaattatgggagctacaagatgtgatttgggtggggacacagagccaaactatatcataaggttgggtaaaatttataactaaaatgatgttttatagtatatcctttctgattatttccattggttcatgctactagtctcaagagctaatagttcattcataccttctcaatagcaattctttccagccagggttaaattttgcatatttacttcttaagttccaggttctgcatttcttgcctggtttttccctccataattgaaagtatactatttaacacagtgagctgtcattatttcttggacaacaatctatccttttaaaagtttattttgaaatctgcttttaaaatgtagtcaattcgtttttgtcaattctccagtttttttgttatgatatgtctagattttcttatgacatatatagcattccagagaggtaatgtttcgagattccaagagatgtactacgtttctcaatagttttgttgctggtaagataacattttaagataatgggcagctaaaaaggtttttagtatctacttcaataatggcttgcttaaaatttcagagtttggggggtttttagtattattttaagaagtataatttccttagaataaaatgcactgatcttaagtgtagaagttgaaatttgacaaatatatatatcagcccaaatgtgagcattttatggagagaagttgtgctagatcactcatttaattaccaattctgtaaacactgttccatatagcatcatgtccatgtaaatatgacccaaattgtggaacttttttttctattctggaccccataaggggccaatgcacacctcccttctcccagccccagaggtaggtaaccatttctgtttagttctatttctataactgtttctgatcttaaacttcctaaaatgaaatcatagagtatgtactcttatatctagcttttagtgtctgattttttcttttatttggtgtttgtgagattcagccatattgtttatatcagtattttattcctttttattgctgagaaatattccatgctgtgtatatctcaaaatttgtttatccattctcttggtgataaatgttttggttgtttctcagtctggggcttttatgagtaaagctgctataaacattcttgtgatatctttttgtggacatatttttcttgagtaaatacctaggagtgaaatcgctgggaaggtgtttgactttattagaaactgccagtttcccaaagtgtttttgccattttgcagtcctactagtagtatttgagagttgcttcacgttcttgccaattcagcattgtcagtaatatctcgtggttttaatttccatttcttccttgactaatggtgtcaagtacgtttttctatgcatattgatcatttgtagctcttcttttgtgatgtgtgtatccaaatcttttatccattctaaaattgggttgtctttttatttgtgattgttggagttcttaaatatttcagatcattgattttagaaactcttctctttcccttcttccctccctcttcttaccttttcttacgatacgtctagatttcgttcttctttgacggagtcttgctctgttgccgaggctgaaatacagtggcacgatcagagctcactgcagtcttaaactcctgggatcaaaggatccccctgcctcatccttctgagtagctgggactgtaggcacaagccactgtgcccagcaaattttttggttgtttttatttttgtagagatgtggtcttgctattttgcacaggctggtctcagactccttgccttaagctatcctcccacattctgttttctaatataaggatttaaagctgcatatttccaactaagtatttctttagctatatcccacaattttttgttgttttttttgagatagagtctcactctgaggttgcccaggttggagcgtagtggtagagtcatggttcactgtagcctcaacctcctgagctccagatagcctcccacctcagccttccaggtagctggaaccacaggcatgtactaccatgcctggcttacttatttatttatttattgtaggagatgggtcttactatgttacccaggctggtctccaaactcctggatccaaacgatactcccactttggtctcccaaagtgctggaattataggcatgagccgccgcatccagtccacacctttttttttttttcccccgagacagagtcttgctctgtcgcccaggctggagtgcagcggtacaatcttggctcactgcaacttccatctcctgggttcaagtgattcttctgcctcagcctcccgagcagctgggattataggcacccgccaccacgcctggctaatttttgtatttttagtagagacggggttttgccatgttggccgggcttgtcttgaactcttgacctcaggtgatccgcctgcctcagcgtcccaaagtgcctggattacaggcatgagccaccacgcccagccacaaattttggaatgttgtgtttttcactattttatttattttatttatttatttatttattatgttttatttttattattaatatttttgagacagggtctcactttgtcacccaggctggagtgcagtggtgaaatcttgcctcacggcagcgtccaattccagaagttcaagcgatcctctagcctcagccaccaagcagctgggactacaggcatgtgccaccacacccacatgacgagatggggtttcaccgtgttgcccaggctggtcttgaactcctgtgctcaagggatccacccacctcagcctcccaaagtgctgggattacagatgtcagccaccacatccagccactctcattgtatttaaaagtatttgttaggtttttttttttttttttttgagacgtagtctctctgtcacccaggctggagtgcagtggtgccatcttggctcactctaagctccgctccctgggttcacgtcattctcctgcctcagcctccggagtagctgggactacaggcgcctgccaccacacctggctaatttttttgtatttttagtagagacagggtttcaccgtgttagccaggaaagtctcaatctcctgacctcgtgatcccctcacctcagcctcccgaagtgctgggattacaggcatgagccgccgtgcccagccaggtcttatttttatcctgataatctctactttataattggagtgttcagtacatttatgtttaattttattactgatttggttggacttttgtctaaccattgctatttgttttgctatttgtctcgccttgctatttgtttcttatttttcccaactttctttgttctttcttgccttctttgaataaagcaatttttactttcttttttagctcttctgttggttttttagctatacctctttgtttaactttagtggcaactctaatgattatgataatatgcatctttaacatccctgttgacccaaacactacttcttgtacaatataagaagctcataggccaggtgcggtggctcacacctgtaattccagcactttgggaggctgaggtgggcagattgcctgaggtcaggagttcgagaccagcctggccaacatgatgaaaccccgtctctactaaaaatacaaaaatcaactaggcatggtggcaggcacctgtaatcccagctacttgggaggctgaggcatgagaatcgcttgaacccaggtggcggaggttgcagtaagtcgagatcacgccattgcgcttcagcctaggggacaagagcgagacttcgtctcaaaaaaaaagaaaagaagctcataataatataattccatttacctcactccagctctttgtggtgttgttgtcatatattatttctacgtgtcacaaatataatactttgttactgttattcttgctttaatttttaactattttcaaaaataatcttatatttactcacattactatttctggttctccttatttctttcctcagattcatttttttttttaaatctaagataatttccctttggctttaaaaaaaaaaacctttctttaccatttcacttagtgtgcatctcttggtgatgcattttctcagcttttatatgaaaacatctttatttcaccttcattttttgaaggatattgtcactagatttagaattctaggtttataaaataatgatgcggtcatgtttttatgatttatgttttaaaaaataatcctcatgtcgtagagacaaatactgaagtatttgttcaaaatgaaattatctgggctgggcgtggtggttcgtgcctgtaatcccagcactttgggagaaggcaggcagaacacttaaggtcaggagttcaagaccagcctggccaacatgatgaaacccccgtctctactaaaaacacaaaaatcagttgggtgtggtggcgcacgcctgtaatgccagctactcgggaggctgatgcacaagaactgactgaacctggaaggtggaggctgcagtgagcccagattgtatcattgcactccagcctgagtgacagagcgcgaccctgtctcaaaaaacaaaaacaaaataaaagaaaaaaaaagaaattatatggcttggcaatggtggcacacgcttgtaatcgtagcactttggatggcggaggcaggaagatcacttgaggccagatatttaaaaccagccttggcatcacagagagacaccatctctacatacaaaaccaaaaatcagccaggcgtggtgttgcacacctatattcccagctactcgggaggccgaggtaggaggattgcttgagcccaggaggtcgagactgcagtgagccaagattgtgccactgtgcttcagctcaggtgacagagtgagacctcatctcaaataaataaagaaatgaaattatatgatatctagggtatgagtaggggcatagatgaaatagatgggcattgtgatgaagcttggacatgtgtacagggggttcattatgttctatttttgaatatattttaagttttttataattttttaaaatttatttttatactcagaatttaaagataagatctaaacttcctgataggttttttcatatttgtttgccagaatggtagctgagtggaggttgtctcgaggtgttgaagaacagacacaagctttctttgaaggctttaatgaaattcttccccagcaatatttgcaatactttgatgcaaaggaattagaggtaatgaattttccttcattcccctgtaccatgctagtaaataatgccttaagttgtctgcttttaactcactttcccatctttcctgttactgtaatatttttatactggggcaaaatgttttgaaacatccccaatggttaaagaaaatcataatttatccaaagataaaacaatagtattaccccctccaaagtacaaatattagagcttctctacaattgagtgacttacttccctgaatatgtatatgtatgacaccgtgcatggaaccttgccttcatgagcaatgtagatataattcttgatgtatagttgataagtcaaagcctactgattgttattctaaagctttgcttaatcttagtctttcctatgtccagctgtttttgtacagttaccttaggaaacaatttgtctttttcatccctaaaggtccttttatgtggaatgcaagagattgatttgaatgactggcaaagacatgccatctaccgtcattatgcaaggaccagcaaacaaatcatgtggttttggcaggtttgtttttaaatttatttctattagttgacacagcataattttttagaatttgcttaccacatatggaaatgagtcacaggtcaaaatgtaccagtgtatatagaccccttagtccatgcattataataaatgaatacagattataacagcatccttttaagactattgccaagtaagccacacataccttgcatctttgtccaaagtagagtgtaagacaattcgagatgataaaatttacctacatttgatttaaatggttttggggttttataggactgtctgtagtatgttttttatcatttatacttcattaattatataatgttcagaaggcaaaatttaagagacttggtttagaatcataacggtatctctctaaaaatgtctgccttaagcatggtatatgatgttcaacatcattagtcattagagaaatgcaaatcaaaaccacagtgaggctgggtgcggtggctcacacctgtaatcccagcactttgggaggctgaggcgggtggatcacgacatcaggagatcaagaccgtcctggctaacacggtgaaattagccgggcatggtggcacatgcctgtaatcccagctacttgggaggctgaggcaggagaatcacttgaacctggaaggcagaggttgcagtaagccaagttcgcactactgcactccagcctgggtgacagagcaagactctgtctcaaaaacaaaaacaacacaatgagataccacatcacacttagtattatttttgaagtggagaagaacaaccattgccaagggcgcattgctggtgatagtgtgaaataccacaccactgtggaaatagtttggtggttcctcaaaatttaagcatagaattaacataagatccaggaattccaatccttggtatacagcccaaaaaattgaaagcagagacttaaacagatacttgtacaccagtattcatcattcatttaccgacacaaaatgtggtatatgcatatacagatgctcctggacttggagttttatcctttatatccatcataagtcaaaaatatcttgagttgaaaatgcatttaatacccttatcataacttacccattgtaaagttacattgtaaagtcacaacttacccattgtaaagttgaaaaatcataaatcgaaccatcataagtctaggtgctcctcaacttatgatggagtaataaacccaataaacccatcataaagtcaaaaatttgtaagccagggactgtctgtgttggaatattattcagtgctaaaaagtaatgagatttttggtatgtgctacaacatgaacaaaccttaaaaacattatgaattttaagataagcgaagtaagccagacacaaacggacaaatactgtataattccacttacatgaggttactagaatgggcagcttcatagaggcaaaagtagaatatgggttaccagaagttgcagggagcaaaaatgggaagttgtgtttaatgtgtacataggttttacttgggatgatgaaaaagttggaaatagtggcgatggttgcacaacagtgtgaatgtacttaatgtcattgaattacactcaaaatggttaaaatcgagaatttatgttgtgtatattttacaaaaatttaaaaaattaaaaaaatctggtatacatgtaaaaaaattcatatgagaaacttaaactgagcttctataacaagtaggattacaattgtaggataattaataatactacaataggataaaaattattccttataaaaaagtttttggctgaggcaaaacagttatactacaggctagaaacattctctagaaacctattgttttgagtcagaattgtatgaaataaaaaccacataattctagctatgtgtagctataccaaaacctaaagaacattgagaagaggaggttattgggatatatcctgcatcagaattctgtgagtttgattaaagttgtttattaaaccaaaaagtctgtactgactcaaggtctgtatcctgtgtagccacatgaatatcctataggacgggcaaatctggggctggggggtggtggtgggatggggagtcacaggaagggctgccctagaagagctaatcttaaaactgcgtgagtacggagctcttggtctcagtccatcttactttttatatatccctttaagtatattgtcctaagatttatataaggaaaggttgatggggctttgataaacatggaaatggccctccatccatagtgttaagtaattatctaatgcagtggacaccagagtttcctttaagatttgaaatgagctagatacagtggcttgctcctatagtcccagctactctggaggccgaggcaggaggactgcctgctgcccaggagttagaggctgcaatcagctatgattgcatcactgcaccccagcctgggccacagagcctgggacacctcacctctaaaaaaaataaaagatttgaaatcattatttttctttcttgtttagtgtgctgaatgtaacatatgacatatatatctctttaaatatacttttaacagtttgttaaagaaattgataatgagaagagaatgagacttctgcagtttgttactggaacctgccgattgccagtaggaggatttgctgatctcatgggtatgtatacaggatcacttttcctatacagaaaattgtttatcatgctgctttacgtaaatgtgtatacagcctattagaaacaacaaagacagggatagccattttcttaactattcccagttagcatggatttgtataacctttaaaatagtttttagtacttacctttgtagaaatttttaaccctcaagctagaacccacagctaactcattaggacagcagtcttctgtatgtaaatctgttcatttagtcatttgccaaacatgtgtgtcttaagagtcaatcactattggttgtattatttaacgatgtgagaagatcattatataatacaatagtggattgtagttttagtattgtgtttaaaaccactcttccctgggagactgggagttctttgagaaatggattcatatcttcatctttttatttcttgcccctggcaaagtgcctgttacacagcaatctgctgcttaaaatgaatattaagatgaatgactatggcaatattcactttgttactaaacagtaaattatttaagtaaattcaagtatttccttaataccaacattatcccaagtatcataggaggatacacagagaagttaagatcccaaagcctgcttcagactgaagcagagagtcaaaattagaactaagcaggtaattttgaatacagaacatggaaccagtttagaaagtactttaaaagccagaaaaagaatttggatattaccgtgagggtattggaagctgtggaactttttgaagagaggaaaacttgctcaagctgcatttaggaagatttgataggaagatacagtgtggattaaaagatggtgaggacctagagataagaagaaatcattgcagcaatgatgagaacctgatctcaggagatgaaagtagaaatagaaaagagggggtagatactaggtaaagttccaaaggagaaacaggtagagagcttaatagaaaatgaagtataagagaggggtatcagcaataattgtcatgttatggaacatggagcaatggagaagttaggaagtataaagagtatgcatcgttgtagatgttgggggaggatgctgagcagcttagaacctgctgaatttaaggtaactgctggacaaccaagtagaaaaccccagggaagcagctgtagaggtaacaatatatgagttagagttaagaggaaacagaagaagttgaatcatcagagcagtgacatttgatgctgtgagaatgtgtggtcttaggcagaaatagaatacagagaggagtagaaggctaatgcctagaaccatctgcatgtagggataagacagaaggagatagcctaggccaggcacagcctcacgcctataattccagcactttaggaggctgagctgggtggatcgcttgagctcaggagtttgagaacagctgggacgacatggtgagaccccgtctctactaaaaatacaaaaattagccgggcgtgttgacgcacacttgtagccctggctactgggaaggctgaggcagggagaatcgcttgaacccgggaggcagaggttgcagtgagctgagatcgtgccactgcactccagcctgggaaacagagtgagactccatctcaaaggaaaagaaaagatggaattagtctggaagccaatttaaaggagagaccagagagtgaaaagaagaaagaaatagtatactgtctgagaagcaattagaaggaatttttttcttcagtgctacagagaggtctcagaagggtgatttctaggaaagtttttgttaggagacagaaacagtgagattgtggtttggagaattttagaggctatctagtttattttgtttgttttagtttcaaatctttattcttttttactttttaaattattcttaattgacataattgtacacatttaggggtacagtttttattttgatacatgtatacaatatataatgatcaaattggggtaattaggatatccatcacctcaaacatttatcaattctttgtgttgggaacattcaaaactcacttttctaactatttataaacatacagtccaggtgcagtggttcacacctgtaatcccagcactttgggaggctgaggcaggaggaacacacgagcccaggggtttgagacaagcctgggcaatatagggaaaccctgtctctacagaaaatttagaagttagctgagcgtggtggtacatgcctgtagtccctgctattcaggaggttgaggtgggaggatcacttgagccttggaggtgaaggttgcagtgagccaaggtcatgccactgcactacagtctcagtgacagagtgagaccctatcttaaaaatacatacactgggcgcggtggctcacgcctgtaatcccagcacgttgggaggccgaggcaggcggatcacctgaggtcaggagttcgagaccagcctggccatcgtggtaaatccccttctctacgaaaaatacaaaaaaaaaaaaaaaaaattagccaggtgaggtggtgggagcctgtaatcccagctacttgggaggctgaggcaggagaatcacttgaacctgggaggcagaggttgcagtgagtcgagattatgccactacattccagcctgggcgacaagaacaaaactccaactcaaaaataaataaataaataaataaataaaatatatatatatatatatatatacacacgcacacacacacacggtaaattgttgttgattatagtcattgtatagtgctatagaacactagaacttattcttcctgccgatctgtacttgtgcatctattaaccaacctttggctctcccctcattcctgccacccttctgtagtaaccactgttgcactttgtacttctatgagatcggctttcttagctttcacgagtgacagcatgtagtatttatctttttgtgcttggcttatgtcacttaaaacgtcctccatgttcatctatgttgtcataaatgacagaattttgcttttttaaaaaatgtctgaagtattccagtttgtttatacaccacattttctttatccgtttacctgattatggacacataagttgattccctatcttggcccttgtgaatggtgctgcagtagacatgggagtgcagatgtctgttcgacatactgatttccttttctttagatgaatgccccatagtgggattgctggatcatatggttgttgggcggctgagatgggtggatctcttaaggccaggagtttgagatcagcctggtcaacatagtgaaaccctgtctctactgaaaatactaaaaaaaaaaaaaaaaaaaaaaaaaaattagctgagagtggtggtacacgcctgtaatcccagctgcttgggaggctgaggcacaacaattgcttgaaactgggaggcagaggttgcactctagcctgggtgacagagcaatactctgtctcaagaagttaagaagaagaatttacatccctgccaacagtatataagagttcctctttttccacatccttgccagcatttgttattttttaatctgtaacagttattctaactgaggtgagatgatagttcattgtggttttgatttgcatctccctgatgattagttatgtttaacattgttattttgagagatatctatttagctcatatcccattttttaatgcattgtttttcttcttttttgctgttgagttcttgtatattctggatattctttgttggatgaattgtttgcatatactttctcccattctgcagattgtctctacactgtgttgattgtttcctttgctatgccaaagctttttagtttcatataacccaatttgtctatttttatttttgttgcctgtgctttttatgtcctctttataaaatcttggctcagggccaggtgtggtggctcgtgcctgtaggcccagcactttgggaggccgagacgggtggatcacctgaggtcgggagttcaagaccagcctgaccatggagaaaccctgtctctactaaaaatacaaaaattagctgggcgtggtggcgcgtgcctgtcatcccaactactcaggaggctgaggcaggagaatcacttgaacccaggaggcggaggttgaggtgagccgagatcgtgccattgcactccagcctgggcaagaagagcaacactccatctcaaaaaaaaaaaaaaaaaagaaaagagaaaagaaaaatctttgctcagacctgtgccctgaagcatttttcctgtttaatccattttgagttgatttttgtacgttatgagagaaaggggtctactttcatttttagcatatagatttctgttattccagtaccatttattgaagagagtgtcctttcccccaatgattgttctttttttttgagacagagtctcactccgttgcccaggctggagtacagtggcgagatctcggctccccacaacctccgcctcccaggatcaagcaattctcttgccttagcctcctgagtagctgggattgcaggcacgcaccaccacacctggctagtttttttatttttaatagagatagggtttctctatgttggtcaggctggtcttgaactcctaaccttgtgatctgcctgcctcagcctcccaaagtgctgggattacaggcatgagccactgtgcccagccaatgattgttcttagtgtctttattgaaaatcagttggatgtaaatatgtgggtttgtttctgggttctctcttctgttccactggtctatgtgtctgctattatgccagtaccatgctgtattggttactatagctttgttgtatatcttgaagtccagtagtgtgatgcctccagctttttgttcagaatggctttggctattcaggatcctttgtagttcagtatgagttttaggattgttttttctatttctgtgaagaatgtcattggttgtttttgtttttgtttttgttttttgagatggaatgtatcactctgtcacccaggctggagtgcagtggcacattctcagttcactgcaacctctgcctcccgggttcaagtgattcttgtgcctcagcctcccaagtagctgggattacaggcatatgccaccacacccagccactttctgtatttttagtagagatggcatttcgccatgtgactggtctggtcttgcactcctgaactccggtgatccgcccaccttggcctcccaaagtgatgggattacaggcatgagccactacacccagccgtcattggtatttctgtagggattgcattgaatctgtagaaatttttaatagtacggttattagtggagtattaatttttcaacccatgaacatgggatgtctttacattttttgtgtgttttcttcagtttcttttgtcagtgttttatagtttttgctgtagagatcgttcacctccttggttaaatttatttctaggtttttgttgtttgtagctattgtaagtaggattgctttcttgatttctttttcttctagtttgttgttttatagaaacgctgctgatttttgtatgttgattttgtatcctacaactttacttaatgtgtttatcagttccaataattttttattggtggagtttttaaggttttctgtatataaggtcatgttgtctgcgaacaggtatagttcaacttcttcctaattctgatgccctttatttctttctcttatctaattgctttggctgggacttccagcagtttgttgaataaatgtggtgaaagtgggcacccttgtcttgttccatatcttggaggaaaagcttttagttttctctgttcagtatgatgttggctgtggatttgtaatatatagcctttattatgttcaggtacattccttctgtgcctaacttgttgagagtttttcttatgaagtgatgttggattttattaaatattttttctgcatctattgagaagatcatatggtttagcccatcattctgttgatatactttgttatgttcattgatttgtatatgttgaaccatccttgcaacctttggatctttttaatgtgttgctgaatttgatttgcttgtatttcattgaggatttttgcatctgtgttcatcaaggatattggcctatagttttcttttcttttcttttcctcctttttttttgtttttgtttcttgtatccttgtctagttttggtatcagggtaacgctggccttgtagaatgagtttcaaaaaattctctcttctattttctggaagagcttgaaaagaattggtattagttcttctttaaatgtttgttagaattccattggttcctagacttttgttttctttgatgggagactttttttttttttcttgagacagagtcttgctctttcacccaggctggaacgcagtggcacgatctcggctcactgcaacctccgcctcacaggttcacaccattctcctgcctcagcctcccgagtaactgggactacaggcgcctgccaccatgctcggctaattttttgtctttttagtagagacggggtttcaccgcgttagccaggatggtctcgatgtcctgaccttgtgatccgcccgccttggactcccaaagtgctgggattacaggcgtgagccactgtgcccagcttttttttttttttttttttttttttttttttttgagacagtcttgctctgacacccaggctggagtgcaaatgggagactttttattacagattcagtcatgttacttataattgatcttttcagcttttctgctttttcttggttcagtcttggtaggttgtatgtgtccaggaatgtatcaatttccataggttttctaagttggtgtgtagttcataataatttctaaaggtcctttgtatttctgtggtgtcagttgtaatgtctcccttttcgtttctgatttcatttatttgggtcttttcttggttagtttagctaatggtttgtcaattttgtttatcctttcagaaaaaaaaaacaacttttcatttcatctatcttttgtcttcatttttagcctcatttttgtttatttctgttttgatctttattatttctttccttctagtaattttgggtttgctttgttcttttctggtttctcaaagtgtatcattaggtcatttgtttaaaatctttccacttttttgatgtaggcatttattgctataacattaccttttaatattggttttgctatattttataattttcaatatattgtgtttccatttgcatttgtttcatggaatttttaaatttccttttacatttccccattggtcattctggagcacgtttaattaccatgtatttatacaattttgaaagttcctctttttattgatttctagtcttactccattgtgttcagaaaatatatttgacattatgacttcagttcttttaaatttgttgagacttgttttgggtcttaatatgtggtttccccaggagaatgttccatgtgctgatgacaagaatgtgtattctgaagctgttggatgaaatgttctatgaatgactgttaggttcatttggtctgaagtacagtttaaatccaatgtttctttgttgattttctgtctagatgatctatccagtgctaagagtggatattgaagtccccaactagtattggagtctgtctttcccttttaatataataatatttcctttttatatctgggttctttggtgttgggtgcatatataactctcatatcctcttgttgaattggtccctttatcattatagaatgccctttgtctctttttatagtttttgatttaaagtctgtttgcctgatatatgtatagctactcctgctcactttggatttccatttccatgaaatatctttttcatcccttccttttcagtctgtatgtgtctttacgggtaaagcaagtttcttggaggcagcatatgatagttgggtcatttttctttttaaatctattcagccagtctatatctttttagtagggaatttatccacttatattcaaggttattactgatagatcaggacttactcctgtcatttttaaaattactttctggttgctttatatatccgtcgttcctttctttctctcattgtttatcattatggtttttgtggttttctatagtgctaaggtttggttcttttttcccttagtgtatctgctctaccagagtgttatattaatactttttgtgtattttcatgagagtgattatcatcttttcacttccagatgtgggagtccgttgagcatttttcataaggtgatgaattccttctatttccccatgtctgggaaatactgtatttctcctgtatgtctgaaggatggttttgctgggtatagtaatcttggctgccaatttttttcttgcagtactttgaatattatctcattctctcctggtctgtaaggtttctgcagaggcagccatctagtttaaacttccacccagcacaggaagagaaagttttagaggtggtgtatgtaattctttaatgggatgcttcttgaccttggggatggatccaacatcccacttttattaatatatattcataatatcccctttaatacactgatttatggatgaaataacctattgacaatccctagaaaatacttatacatagccttaactgtaatataagggattaaattttttaggtaatttataatgaaataatatgtgttttaatacatgtctatttggggacaactatgttagaagatatacctaagaagtcaaatatttgttcctacttataagaaaaggtttaagacaagatcaaaagccattctctataagaagtactggaagggctgagtgcggtggctcacgcctgtaatcccagcactttgggaggctgaggcgggcggatcacctgaggttgggagttcgagaccagcctgaccaacatggagaaaccgtatctctactgaaaatacaaaattagccaggcgtggtggcacatgcctgtaatcccagctactcaggaggctgaggcaggagaatcgcttgaacctgggaggcagaggttgcagtgagccaagatcgtaccattgcactccagcctgggcaacaagagcgaaactccatctctcaaaaaaaaaaaaaaaaagacaagtagtactggaaaataaaagaacagatgagaaagataaataatagacttaagtatatgtgataacaaaaggagggaagtaacctaaataaagtatgaataatacacctgcaaaaataaattatagatggtcaaggtggagaaaaatgaggtagatcttaaaagcatagtatcagaatatatctcctgtcatgaaattctactataggccaaggctctaacatgtaaaaaagcctcggagaccataacatttgaaaggtggctgaaaataggaacataggtacaaaagtctacacagaagttgtatggtttagggacagtgtcagagtttttaatatttgattttaaatctattaaaagcaattcagaatcctttctgttacatactaatgtgcattattaaatgaaactcctttccatctatgtagttaaatatgctgctaggtatggtgggcacacatctgtagtcccagttatttggaggctgaggcaggagaattgctggagcccaagatttcaagcctgtagtgcactataactgcttctgtgaacagccactgcacttaagcatgggcaacatagtgataccctgtgtcttaaaaaaaaaaaaaatttataaaaaatgaaatgtgaccaggtacagtgactcacacctgtaatcccagcactttgggaggccgagacggttgggtcacttgaggtcaggagttcaagaccagcctggccaacatagtgaaaccccatctctactaaaaatacaaaattagccgggtgtggtagtgggcacctgtaatcccagctactcgggaggctgaggcaggagaatcacttgaacctgggaggcggaggttgtggtgagccaagattgctccactgcactccagcctgggagactccgcctcaaaaaaaaaaagaaaatgctataaaatattgagtagagggtggacatgatggctcatgcctgtaatcccaacactttgggaggccaaggtgggttgatcacttgaggccaggagttcaagaccagcctggccaacatggtaaaaccccatctttactaaaaatacaaaaattagttgggtgtggtggtgcacatctgtaatcacagctactctaaggcatgagaattgcttgaacccaggaggcggaggttgcattgagccaagattgtgccactgccatccagccagggtgacagagtgagactctgtctcaaaaaatatatatattgagtagagagaacatgcagagtgagttaattttaatttatgtgttgaacaccacagaataattttaactgtgtttttttataacgtttcctatattactggactttttacataactacttgtgaaaacaattcagtgttattaaatacaaaagcactaacaatttatattgggtatacttagtatacagggtttagtcaggtgggacatgagaaagttctttgtgtctgacagtgtcacacattacagaacagttagcgttcctgcccccttctaattaaaatatctagtagcattaccagtcattgagaccaacaataaatgcttcctagggaaaagtaatgatcttttaaaaaactggtgtttttatgatcacttttcacagctatctccagcagcaggtaaatgaggggcaagtattttatgtttatacttgtatctgtttttgtaagggtatgccctacaggacctgtaagttccagcattaataatatggaattcactaggatatttacatttcacaaagttttattaattctgtatttaaatcaagttttattgtagtttcgttattgtctttcaaactactaaaattaagctttttgtgtgttcttgtgtaagcttttattaatcataacaatgtgttattccggctaaagaatgctagatgaaactgcattttctcctttgggacttatattaacaaactatagtcttcaaacttttacacttaccagaatcacccggaagcttgttaaagcacatattgctgagcctgacccctagagtttcttttttgtttgttggttgcttttgggttttttgggtttttttttttttttggtttttttttttttggttttttttttttttgagatagggtctcgttctgtcacccgggcgagagtgtagtggcgcaatcttgagtcactgcaactttgctgcacagattcaagcaattctcctgcctcagtctcctgagtagctgggattacaggcatacgccaccacacttggctagtttttgtatttttagtagagatcaagattcaccatattggccaggctgatcttgaactcctgacctcaagtgagctgcccacctttgcctctcaaagtactgggataacagacatgagccaccacacctaacccagagtttctgaattagtaagatgatgtgtggggcctgaggatttatggttctaacaagttccctcatgatgctgatgcttgttggattggggaacacagtttgagatccactatactaacaaactgtttatgatttcattatgttttagggagcaatggaccacagaaattctgcattgaaaaagttgggaaagaaaattggctacccagaagtcatacctggtaagtacaatcagaatggatagagaaaacagcttttgtccagttatctgtagctatttaaagccagctagaaattaaaaatgatatttagtagatttacagaatagcacagccatcatagcaatccagtttaagagcattttgttcacccctgtatgattccttacaactatttgcaatcaattccttttttcacatctgaattttttttctaatgtgggatttagagttattttaacttttctctgagggcagcaaaagaaagttaggagacctactttctaacatcatgaccacaaatattctcatttgaaatctaattacatttctaaaaatgtagaaaactaaatctaatcctaatctgacagcaaatatattaatattttggaattcaacctaatgtcaacaatatttgaaccttattttgtgggatatattttagtggtcacatatggtccttcctggatatctgacctctttactgttttactaatgtctattcctttttgtttttatacataatgttttgtacatgcatgtagtgtttaagtaacaattttattgatatataatttacagattataaaactcaccttcttaaattatgcagttcggttcagtggggtttttttgtttgtttgtttgtttgtttgtttttgagacagggtctcactttgtagaccaggctggagtgcagtggtttgatctcagctcactgcaacctccgcctcccaggttcaagcaattctcttgcctcagcctcccaagcagctgggattacaggcgcccgtgaccacgcccagctaatttttgtatttttagtacagatggggtttcgccatgttggtcaggccggtctcaaactcctgatctcaggtgatccacccacctcggcctcccaaagtgttgggattacaggtgtgagctgccgcatctggcctgttcagtgattttagcatatttatgaggttatgtaagcatcattactgtctaattccagaattttttcaccctcccaaaaatccatgtacccattagcagtcactccctttttaccccgtgtagcccttggtaaccactaatctactttctgtctctatgaattttcctgttctggacatttcatataaaatgaatcatacgataaatatataacttttttttttttggagacagtctctctctgtcacccaggctggagtgcagtggcgtgatctcagctcattgcaacctctgcctcctgggttcaagtgattctcctgcctcagcctcccgagtagctgggactataggcagcatgcaccaccacgcatggctaatttttgtatttttagtagagacggggtttcaccatgttcgccaggctgttcttgaactcctgacctcgtgatccacccactttggcctcccaaagtcctgggattacaggcgtgagccactgcccccagccaaaatatacaaccttttgtgtgtagcttcttttacttagcatgttttcaaggttcatccatggtctagcatatacagtatttcattcctttttaaaattaattgttgggtttaatatacataacatagaatttaccatttttaagtgtgtacagttcagtggcattaagtgcattcatatcattatgcagtcatcaccatcacctatctccaaaaattgtttcttttgttgagacatgtctcagtctgtcacccaggctggagtgctgtagctcaatctccactcatgcaccctccacctcccgggctcaaactgtcctcctaccttagcctcccaagtagctgggacgacaggcatgtgctaccacacctggccaatttctaaactttttgtagagacagagtcttactttgttgctcaggctggtctcgacctcttgagctcaagcaatactcctgctttgacctcccaaagtgctggaattacaggccatcatgccagacctaaaacatttttcatcttgtaaaattgaaatggtacccattaaagcaggggtccccaactcctggtccccagcctgttaggaactgggctgcacagcaggaggtaagtggagggtgaatgagcattacctgctgagctccaccacttgtcagatcagcagaggcattagattctcataggagcaataactattgtgaactgtgcatgtgagggatctagattgtgcattccttacgagaatctaacctgaggtggaacagtttcatcctgaaaccatccccctctccactcctgtccatggaaaaattgtcttccacaaaaccattgcctggtgccaaaaaggctggagactgctgctttaaacaatgactccccatgactccctttccccaggtcctggcaaacatcattctactactgtttctatgattctttagtacttcgtaagtgtagaatcgtaccttatttgtcctttcctggctggcttatttcacttagaataatatctttaattttcatccatgttgtagcatgtgtcagcatttcctcctttttaatgctgaataatatttgatagtctggatatactacattttgtttatacattcatctgtccatggacacttagattatttccaccttttggctgtttatgctgctataaacataggtatactgtggtagaatatagatatatctgtccatggccctgctttcagttgttttgggtatatacccagaggtggaattccttgatcatgtagtaattctatttttaattttttgggggaatctcgccatactgttttccatagtgactacactgcgttatattcctacctgtagtgcagaggggctccaatttctccacatcctcacatccttttcaactcttgttttcttctgttttttttttttttttttttttttttggttgttgttgttgttgttttggtgttttaaataatagccatcccaacaggtgtgaagtggtatctcattgtggtttttatttgcatggtaaaggatgttgagcatttttttaatgtgcttattggtcatttgtatgtctttggagaaatctctatcctttgttcatttttaaatattgttgagttttaagttttttatatattttggataccagtcctttatcagatatatgatttacaaatattttttcccatttttgggttatttcactttcttgatggtatcctttgaagcacagtagtatatttttgtgcttctatagtagtgtataaagtagtatactacactactcatttgattctttgcatatttccttttctcaaactaacaattcttgcttttagttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcatttgcatgcttttctatcagtcttgggtaaggaggggtctctttcctctctccccggccccaccttctgagacttatatgtgaccaggtcacatagatttctgcctctctgcttttttaagtggcaagttacagcccatctggattgtggtattgttcccagaccaaatcaagggttggactgcttattctcgcagcccaataatgaggtgcagatgaactgagaaaggagggagtttatttctgtaaccaggtatggggagaaagcctggaaatgatcccaagaccaactcaaaactacaaagttttccagagcttatttacattataagctatatgtctacatgtgagtgtacattcatctaaagacataagtgattcacttttttaaatctataaataagatctgagccctgaagaccttcctctggagcctcagtaaatttacttaatctaaatgggtccaggtgctggggtgattacccttatcttgtttcctgctaaatcatggaggtttggggacttccttcagacccccagtaaacttgtttgtggaggccttcagaccccctcaataagttccttcagacccccaataaaacttgtttaatcctaaatgggttcctttgttatcttgtcatgcttcaaggcccagaaaaggcctgggcaaaacccttggtggccttttgttacattctagcctttgcataagggccctcactctttcagcttttaatatttaacttaaccactcagtgctgaaacagttgttatggaggcctgcgttattgagatctggcctgccacggtacgggtagaaaaaaactagaaagagctgttgcagatgagactggatttggtgcccatgttgaagatgaagatatctgcaggggccatcaaccaacataaaggcctccatatgaattgcttttctgagacaactaaaagaccgggaccacaggcatgagtgctgagtagagaaccaccaactagctagctgtcaagactgttaccaagactgttctcaacaagctgacctggttaccagcgtcagtagaactttgtcttattaggaagctcaggtgattatgctctcatttaaaacagaaccagtggagagagactaagggaagaggaattttttaatacggctgatctaacatggactagaggacaaaaactgcaggcccctcccaggtcctgagtagttagtagaccctatcctgtttattctgtccaatggaagctgctagaatgctctagtttcattgtggcttagaataaggggaaaaatatgccccgctaagtgagggtcaatggtcagtaagtaattgttcttactggccattggctctcatcccaaaccctacaaatcatcaaactgggactcagctgtgactgactggctgttctctggactttttaagtgtctgtctcacattatgtaactccagtacaggagctgctctctctcccagcccatttcagttgtcaattcttccatgttcataggactcctttgtgatcaggatatctggagtgaggagccaggggaatattcctggttggcaaggaaaagagggccttaaacataaatcccagaaggacactgttgatcacttatgcacaggggtctgttaataagcaaagagtggctatggacaagaggatttcctcaaagcaccccacagggaaggaccttgacaatttgtagtcatacttgaaagatcactaaaaacagccctcctgttatttttcttctaattcagacctgttgttctatttgtcttccatatcatagcaaccagtaccacacccatattcatttaataccaaaacaactgtcaacatttatcactatgtgcaggacactggtagatatgctatgtgcagtgtcacttagtcttcctgttattggtaatgattatctctgttttacaagaaaatagaggctcaaaatgattgaatcatgtccacaactattaagtagaaagaatacaggctggaatccaggatggtttgactctaaagcatgcatactttaccatttttgttgtactgctacttaccacaacactgggagtcgaatgtgaccaattttgccattccatttaattagtctccaaatcctatctatccccaaaactttttttttttgagatggagtcacgctctgtcgcccaggctggagtgcagtggcgcaatctcggctcgctgcaacctccacctcccgggttcaagtaattctgcctcagcctccctagtagctgggattacaggtgcccatcaccaatgcacggctaatttttgtatttttagtagagacggggtttccccacgttggccaggctggtctcgaactcctgacctcaggtgatccgcccgccttggcctcccaagtgtttggattacaggcatgagccaccgcgcctggccccaaaacttttaaaaatccgttctctcagagctgacaacattgccacagcccacgtgcttcctccctaatctggctgaccataacagcatcctgtcttcatttttccatcctcctcgctccagtatatcttctgtactacctcaggattatctgtggaagacctgtctcatgcctcctctacctaaaattttacagtggtttctccattaccgcagaataaaacttttttttcttttttttgagacggagtcttgttctgtcgcccaggctggagtgcagtggggcgatcttggctcactgcaaccgccgcctcctgggttcacgcgattctcctgcctcagcctcccgaatagctggggttacaggcgcacaccaccacccccggctaattttttgtgtatttttagtagaggggctttcactatgttggccagactggtctcgaactcctgacctcgtgatccgcccaccttggcctcccaaagtgctgagattacaggtgtgagccactgcgccgggccaaaactctaagcctgccactccgggacattcttggtcctattccagctcctccttcattctcattttggctcctgtcacatgaactattggccattctcttttttgcttctgggattgtaatctgttaaaatcctttcactcctctcagtctggttctccatgggcaagacagtggtgattcttccagtgcttatcttccaggatgttttagggtccagtctctgcagcacttcttccccttgctaaatgctttcctaatgtttccagcattcaatagaaattcctttggatccagtccttttaaaaatttattttgaaataattttacatttacagagctgttgcaaaaatggttaagagttcctgcacagtcttcacccagctttctccaatgttatgatcccatataaccatgctagaattaccaaaactaataaattaacactggtaaaaataacactaaactacagcccttactcagatttcaccaattttcccacccatgttatttttctttctccttactcctctaatctgtgacagttccgcattcattccttgctttcatgactttgagattttggggggcgggggcggggtacaggtatcttgtagaacatccctcacactggatttagtgaaattttctcatggtttaaggctgggagtttttgtggaaaatgactcggaggtgatgtgcccttaacgcatttttatcggggcacacggcatcaatatctccccttgccagtaatactaactttgatctggttacggtggtgtctgctaggtttcttcgcagtaaagtcaatcctcttaacatgcagacactcctggaaggagaaccaaatccttcctcactgaagagcagctactgtggaatgaaactttggagttagatcatcgttgaatccagcaagctacagtgcctgggagaaacagcatttataaagtatcgaggttaccgatacttccctgaagctaccggagataacgttatgtgcgtgttcagcacagtaatgtggcacagggttcactaaacggcagcatgttttaacagaagttatttactcctagaggacccagaaacgtttgcggcctgccggaacaggacaacatagggctctgggaagagtccccctttcagaggtgagaacaagacagaacacacagatgtgaagtgccttctgctaggtaacgcgaggcggggctgagctcggattctaaagactcccaggccagccctaaccaattcatctccgagcttgcacggcatcttacccggagactcgaggtacctgactccagccccaccccaggcctgcccgatcccgaagcgcattttggccctgggcctctctctggctcagtctgggcgcaaagcgggtctcagcaaccgtcccacttgccttcataccctcccaccacgctccactcagggactccagaaccagcttagacctccattgagagctgaaagcctcttccgataccgagaaccagcactgaaagcctcttccgataccgagaaccagcatggtttttgttttgttttgttttagtcagggtctcttgctctgtcgcccaggctggggtgcagtggcgcaatctcggctcactgcagcctcgaactcctggtcaggcgatcctcctacctcagcctctggagtaactggaactacacgagcgcgccaccacgcccggctaattttgtttattttttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcaggcgcagaaaggcacaggactcgctaagtgttcgctacgcggggctaccggatcggtcggaaatggtgagcgtgcgccggggtcttgtggctggcggccgcccaccaccccacgccaggccttcagtcttccgaggatgaggggatctcagagctccggacagggaatcggtggtggctgggcgtggccgggcccgggccccagccgacttgagggtggaacccggcggcggaggcctctaaagcctgaccgaggcggggccgccggatcccgctgccccttgaccggaagcgggagcccagcctcggccaggaagagatgatgggcgaggggtgggcggcggccctgcagcctagagttttggggccttggtgcgcgatggcaaccctggcaacgtttcccgggagctcagtttgtggcaggctctgccaagcactttatgtatcttgtatttcctccgcctcctcccagctctgtgaggtagatacaatctttagtcccattttgttatacatatctgttattcagcgccccgagaagccaagtgctttgccccaggaaatagtggagatggatttgaaccctagaagcttgacggccgccactctgtcggcgtggttctttctagccgctgggactgggtgccagagtcaggaacgggcggggtctgctcttggggatcccaaagcttgctttctaccttgcttgctgcagctgtgggttctcaacgccgttacaggttttgtgtttgtaatcctcacagcttgggcaaaatttgaaaaagtttcaaattttaagccatgtgaatatattactttttcaaaaatcttatttagaaatctagagcttgtaataaaaaaattgaaaaaagaaaccgtgtcatcacctagaggcaaccacttacagtagtcatatgacttctagtcttttttgcttgtttttggtttatacagtttagcccctattgaatgtgcaattgtgggttctgtgtttttcattattacaccacaatatctccacatcattacaaacatgtaataatgcttcaaatatgtataacttcatttttcacatcacttcttaagctgtaaaaaaaattgatatataatagttgtacacatttatgttgtagatatacatgtaatattttgatacatgcatatgatgtgtaatgatcaaatcaggctatatttattatagaatatccatcaccttaaacattcattatttctttttttttttttttttttgagatggagtgtgtctctgtcgctcaggctggagtgcagtggcaccatcttagttcactgccacctccgcctcccaggttcaagtgattctcccgcctcagcctcccgagtagctgggactacaggcgcccaccaccacgcccagctaattttttgtatttttagtagagacggggtttcaccgtgttagtccgcctcaacacggtggtctcgatctcctgacctcgtgatctgctcgcctcagcctcccaaagtgctgggattacaggcgtgagccaccacgcctggcccacattttctttatccatttacctattgatggacgctaattccataatttagctattatgaatagtgctgcaatatgaacatgaggatgtagggatgcctttgatgtactaatttccgttcctttgaataaatacccagtagtggtattgctgatttatggtaggttttttttttcgtttttgttgttgtttttgttttgttttgttttttcgatgcctttgtcgaaaatcagttggccgtaaataagtggatttatttctgggtcctctattctattccattggtctgtgttttataccaataccatgctcttttggttactatacctttctggtatattttgaaatcaggtagtgtgatacctcaagctttgttcttttcgtccaggcttcttttggcttttctgagtcttttgtggttccatacgaattttaggattgtttacaggtaatacttgcacacagtaaaaaaataaatgatgtaaaaggatctaagtgaaaaataaaattcccactctcctaacccccagtctcagtctctcctcctttagaaacaaccattgttagtttctttttttttttttcttgcaaacttgaccctcctgggctcaagtgatcctcctgccttaattccccaagtatctgggactactggtgcacgccaccacaccctgctaatttttttgtattttttttttgtagagttggggttttgccatgttgcccaggctggtcttgaactcctgggctcaagtgattcacccacgttggcctcccaaagtgttaggattacaggcgtgagccaccacacccagctgttagtttcttatgcatctatacaagcacttatatggcccccctttttcttacttaaactgtagctttctagaacctgtattatgctactccgtggttatactcataaaagcaatgcaaatttagatgcctagtttaactttttttttttttcttttgaaacagagtcttgccctttcgcccaggctggagtgcagtggtgtgatctgagctcactgcaacctctgcctcccgggttcgagtgattctcctgcctcagcctccggagtagctgggactgcaggagcatgccaccatgcctggctaatttttctatttttggtagagacagggttttttttctatttttagtagagacagggtttcaccatgttgaccaggctggtctcaaactcatgacctcaggtgatccgcccacctccgcctccaaaaatgctgggattatgggcgtaaaccaccatgtatgttaacaatttgaagcagtaccagaggatataatatagaaagtttatgtggtccccatcttactaccccgtggcaacttctgttggcagttgggtgtgtttccttccagatgtgtttggtgcataagcacatttatgtataagctgtttattagatgaaactggaatatatatatatttgtatatgttaactttactttaaggctgaagtggagagatcgcctgagcccaggaggtcaaggctacagtgagccgtgactgcaccactgcactccaccctgggtgagaaaaaaataagagaaaacagaagttgactttaagatatatatgtatatatcttattctgcaacttgttctgttcacttaaaaatatcacacatttttctgtgttattatatgcaggtccacttcattctttttaaggtctgtatcgtatcctagtcccatatgtacatttaggtggtgtatagtttttttattccagacactgctgcagtaactgttcttgtcttttttgcactcatgctagtggttatgtaggatagatttctacaagtggcacttttggcttgcatattttacattttaggtggaaactgacctttagaataatgatataaaaatcatctataattggccggacacaatggctgacgcatataatcccagcactttgggaggccaaggtgggcagatcacttgaggtcaggagttggagaccagcctgggcaacatggtgaaactctgtctctactaaaaatacgaaaagtagccggaagccgtgcatctgtaattccagctgctcaggaggctgaggcactagaatcgcttgaacccgggaggcgggggttgcagtgatccgagaccaggccagtgcactccagcctgggcaacagagcaagactctgtctcaaaataaataaataaaattaaaaaataatcacatataattctcctcgtccagtttcactgtgccacataactattttcatctttgtatgttctccttcctcttttgttcacatatgcatattttccaagataatgcatgctgagttttggggggatttttttctttttttgttgttttaatatccaaaaacatttaaccttgttgtcatatcatctttgtgattaactacttagtgactacataatactcggtgaaatagttgtaccataattggccaaatatcttacctgtgtacatttgggttgctcccatttctttttggtttgtttgttttagagatggagtctcactctgttgcccagactggagttcagtggctcaatctcagctcactgcaacctctgcctcccaggttcaagtgattttcctgcctcagcctcctgagtagctgggattaacaggtgtgcatcatgacgcccagctaatttttgtattttttagtagaaacagggtttcgccatgttggccaggctggtctcaaactcctgacctcaggtgatccgcctgcctcagcctcccaaagtgccaggattacaggcatgagccaccatacctggctgcttccatttcttaattagtagaaatagtgctgtgatgatgcttctgtgaatatcttgttttgtttcattttaacttacttattagattatttcctcaggataaaattcttaggaaaataatttctgaggtggaaggaccagtgcttttatggttcttgcaatatattgtcctgtagctttgtcaagattgtattgcccttgcacctgccagttttgtaataacaatgccagcatttaaaaataaacctcagcattgctataatttttcatttctgtcttttttttttgaaatggaatctcactctgttgcccaggctggagggcacgatctcagctcactacaaactctgcctcccaggttcaagcaattttcctgcctcagcctcctgagtagctgggattacaggcccatgccaccatgacggctaatttttgtatttttagtagagacagggtttccccatgttggccaggctggtctcaaactcctgacctcaagtgattcacccacctcagtttcccaaagtgctgagattacaggtgtgagcaccacgcccagctgaatttttcatttgtttgtgagggatgatgaccatggtttgatgtgattgtaatttctcgtaggcatattttctactagtattcttttgtgcactacctactagagacttgctattgttcttagtcattttgtgttttttttttatttattttgtctgttatatttgatgcaaatacttttctatcctgttagattagttattcttatacagaagttttatgtttagtggtcaaattggtcatagttctttgtcagtcatttgcttccagtggtcatccctcctatgctgagccaatggatcctcctggatctttattgctgcttgtttttccatgtgtcaggaatgtgcatctgggaactagagaattggggaaccttgtctccatcatcccattgcccagagtgcatttctttctcatcatttgattcttggcttaaagatgacatacttatggccgagaatggtggctcacgcctgtagtcccaacagtttgggaggccaaggcagtagatcacttgagcccaggagttcaagaccagcctgggcaacatgtcgaaaccccatctctacaaaaaattagctgggtttggcagtacacatcagtagtcccacgtgttcgggaggctgaagtgggaggatcacttgagcctgggaggtcaaggctgcagtgagccatgatcgaaccatggcacgcctgggtgacagagtgagaccctatctcaaaaaaaaaaaagattacatctcctcaggtgttcctgaccacattagccagagtagcatcccttgccccacagcctagtccctgtatcctgcaagaatcttgctcacttgtttaagtctctttcaccagaatgtgagctccctgagggcagggacctcctcagttgtggtcaccagtatattcagctcttctgttgacctgcagtgtgttcttgggcaaaacccttctcctttccaaacctgtttccccatcactaacatggagatcatactaacccatgaatgggagtttcagaagagagcatgtgtctgaaagcaatatatgacccatagtaggcgctgagtagggaaattatacctatgtgtcctcccattcctgatagatgtgtgagatgtgtgtttacttttcttttttctttctttcttttttctttttcttttttttttttttttttttttgatgagtcttacactctgttttccaggctggagtgcaatggcgcgatcatggctcactgcagcctcggcctcctgggctcaggcaatcctttcacctcagcctcccaactagctgggactgcaggcacacgacaccacgcatggttaattttttttatcttttgtagagacgaagcttcaccatgttgcccaggctggtctcaaactcctgggctcaagcagtctacctgctttggtcccccaaagtgctgggattacaggcatgagccactgtgcccagcccatgtttacttttaaacagccagatcttagtatctggttctcgttgagtttcagatcacctaaaccttagctctttttcacactgtggactgtgaggccatgtccccctcctgtacttaaaaaggttgatttcgtgaaacatagttgcagaaatgctttttatttgttccttcagtatttattgagcctatcctatgcgaggtactggggctataaagtctggtctggtttcctgattccagggtgccttgcgtctggaggaggagatgaacgtgacctaaacagttgcactgcattgtggtcagtgctgcgaaggctgggggcctcggtgcccagtagaggggctgatgtcagagaagcctcctgcgggctctggagctgagtccaaagggttgggaggtagttacatcaagcagtgagtgaaggagggaagcttgtttccttcagaccgagagcagcacctggcagggcaggggtaggaggcttccgcaggctgtgttcgccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggtgagccttctctgatgatgtatttcacattcccatcacccctgcattccaggtcccgtttccctgctgtagctgacatttatgttttacttctttttgcttatttaatgtcctttcccacaaatgtcagtttcgtgacatgggatttttgttatattttgttcactgcatcatcacaggcctagaacaatgtctggcatatggaaggttgccatgtagttactaaatgaatagcagtcttaagaaatttcatctttttcatttcagccccattctccaatctctgggggctgttttggatttagattctgacatctcggttttcactttctttcccctttctttctgggttgattgcagattgagctgtcttaaattgtcatccaagttattcttacatcttattctgacaacattgagtgtatcagagccttgtggcccctgtatcatagacttcttttggatgcatagatggggggttaaaatgtttttaaatagaaacaatacagtagaatgaaaaagggtgttttgaaaaaaagaaaataaaacctttctataattccttgcccttaatgtggctcttttttcataatctcctgtaaccttttgttttcatgtgattgcagtcaccaaagcactttatttttgcattttgctgttttcacttaacattatagcacacaccttttgtgatggtataacatggtctaatcaccatggttaatatgtgtattcctattagtggatgttccataatctacttggccttttccctaattgttaggcatttttagttctttctgcattctgctattgcaaatgtcactgtactttggtccatgatgaatttccaggagggcgagcagggtagaatgagtactgtccagtgagtactgtccagcagtgaccactattgtgccccactcctccctttcagaatagccgttggcatacagtaggagctcagtgagtgtgttgactgacattcgatctcatacacgcatgacccactgcattgtactctcacgtccacagagccctgtcattgtacccaggctccagatcttagaggcataagtccattttccacttttttttttgttttttttttttggaaatggagtcccagtcgcccatgctggagtgcagtggtgcgatctcggcttactgcaagctccaccccgcgggttcacgccattcttctgcctcagcctccccagtagctgggactacaggcgcccgccactacgcccggctaattttttttgtattttcaggagagacggagtttcaccgtgttagccaggatggtttctatctcctgacctcatgatccgcccatctcggcctcccaaagtgctgggattacaggcatgagccgccgcaccggccccatttgccactttataggaggagcttgtttacccttccctccagtgttcgagagtattctgtcacaggggagtgggtggcagtgactggattgtcagccttgtgccttccagaaaaacaagaattcattgtgctgtctccacccagtgttgaggatccccccccccatttcttttggtgaatggagcctctgtttctaacaactctcagcctttgaggggcttctgactggattctagaccagtctggaaggggccgcctgagaacaggtatacctcagggctagtttccatccacaggaagaattaagtctagttcagttaagcggtgtttatcacacttctactccacagacctttttagagtctctaagaaatggacatagtacctaatgcatgtcccagagaggcacacccagggatttggggagtcacacgtaggcagactccatcaactgggggatcagtaaaggcttcgcggaggagatgatgtcttagatggtcaagaggagtttgttggatttcagcagagaagaggccttgtgggataaaaagatgtagagatagggaggtgtgtcacggagctggagagtggagggaagggtaggacaggagtgacaggaggcctggcatggcagaatgaggacccgaactgcgactgcccctccacttacagatgccatatgcaagagtagcccaccagagcagtttctgggtaatcaagattaatgagccccttcccaaggcacacttcttacagctgagtgctgtgcatcacactatctcagatgcctgccgcagtcactgagtctatcctcatgtgctgtttgggccacaaatgacaaagtgttgtcttcctgttagatactactctctgagttttcttaaatcaacagagtcccatcccccagctatgccaaatatgtgagtcatggacatgtatatacatgggaatggtgtttatattctgctccccaacagctgaggagggtgggataatagtgcctggtgggcagagcgccaggagcagccctgtcctgcgtgggggtgtgagcggatgctctgggcactggtggtggccggaggagcacgtcagatcagcctggggaactttgagggtgtgccaggtgcctgagtattacttgtttgttgttggaagacaaacgtatgattcatctgcctggggtatgaggaagttaatcctgcctatcggcctctcctaaccttggtcttgttttctggcaggcagaggtggaggagacactgaagcgactgcagagccagaagggagtgcagggaatcatcgtcgtgaacacagaaggtacgccctccctcccgccatgacccgcacccaggcaggcccagaagcagccataacacagcatagcacttgctgttcactaagcccttcatgaatctgatctaattttaggcctttttaatttttaacacctccagtgttcttttttttttttttttttttttcattaaggctagtcaggtgaagcagcgggagtggagaagggacaaagaaatcggtaactggttgtgagcaattagttgtaaactgcattcagaccagccacctccagtgtcctcacaaagggaaaatccgctcaatcccaccaccctgacagatcacacttcagtcttccatgcttactcagcctcgtccagcacagttccagaggaccataatcatagttgttacccttgggcatatgtttacacttgagctttttaaaatattgcttcatggtttacataaacaaattaagtgccacgacaatgttcattagcccaattttgttgtttctactttttagtaaatccattaagtggatattacatccccatttgtgttgattctgctttattggctggatagttctctagttaactcctctgtgcctgcagctcccctccaccccaacaaccctttctgagtggtatctgtgtaggtagaagtgtacagatactaactttcccagactgcactggacaggaagggagctagcatttatcacatacccgctctgtgccaagattctggctggtgcagccctgtcgtctgcattttgcaatggagaaaactgagtctagaaatgtaattgatcggcctaccatcacacagtcgagatttaaatccaagcccgtctgagtgcgcttgggtgctttctcccgcgccaggctgtaaagaaccagaatggcccccagaccctcacgctccaggcagcagtaaggacagggactctggaatccagcagttgtgagtttgaattctgcctcatctcctgactagctttgtgaccttggccaagtcgcttaagcctgtaaatggggataatacttatatctaccttataagttgaagagtaactaagaatgaacagcgtaaagcatttagtacagtatcgtcaccatctgttttgagctgtgaggcatttgttcatacaaactctgatttacctgattgggttcccctgttgggttgggagcatccacatgcttcatgcctctaggccacagtgtttcccacacgtattcattctttgaaatcacccgggggtcctgttaaacatagctttccaggcctctgcaccaaaaagtctaatttattagagccaaagcaagacctgaggaatctgtgtgtttacgaagcaccccaggagattcttatgatcagacaggtttagaaaattctgctttaggggatagattctaatcagaagaggctgcagtgagagccacaggcctaagattcacagcagttctgtctccttccgaaggccttcccttggagagactgcctcagatcatgttttcagggctgtggtccttaaacccaggggtcctgtgctaccctgggagtagaggtagaggctggggttcctgtcctccacttcagtcagagcacacacactaagaaccatcagttcatgtttctacattggttttaatttggaaaggggtttggccaatttaaaaactaccctactggagtagccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaactaccctactggagtttacaaaaataacataaaccagtttatgtgagacttgggaggagaggagtccactgagacactgctgctgatagagcagcgtgaccagtgaaggaagaccaggaccatgcctgactcacctctgttcccgtgtcattcaccacaggccgcagagtcaggtcagtgaacgttaaatgaaccaaccacagtgggtgttgccatcagcccctttgatttggtaattcttgaggactgtgttgagaggaaataatcccaaaggaaaaaacctgaaatttttgcaagcatgttagatgccataatcagtagattaataattgttataatggctgggcgtggtgcatggttgctcacacctgttctcagcactttgggaggccatggcaggacgattgcttgagccaaggggttcaagaccagcctgggcaatgtagtgagaccccgaactccacacaaaaaaaagaaaaattaggcaggtgtggtggcacacgcctgtagtcttagctactcaggatgctaagacaggaggattccttgagcccgggagttcaagactgcagtttgcttcaaggcttcttgctcaaagctttgattgcactccagcacagagcaagaccttgtctctttaaaaaaaaaaaaacaaaaagtaacaatgaagtgtgtaggcccttcagtgcccagcccaggggctgctcccacaggccaggatttaccagcagccctgtgggtggaagtggtacagcagtgcctgtgtctgtcacatgtctggtgtgctgccaggcacggtttgtttatgtgtttcttggctgcctcgtagggtagacattattgcggccacctttacagacacacttggacatcccaagaggtcaggccatgcccggttgcggggccccccaaattctctagcccagtgtattcagtgggctctaatttgttcagtgctcttagagagcctcttatgtgtgtcttcagtctaggccttgttttggagaagcagagttctcgcaattcctacttaagcagaatgaaagccatcaagggcaacaaagtggaggtgctgtgtccttggatagaatgttgatttccagccaggcgtggtggctcacgcctgtaatctcagccctttgggaggccgaggcgggcgtatcacctgaggtcaggagttcgagaccagcctggccaacatggtgaaaccttgtctctactaaaaatacaaaaattagcctggtgtggtggcgggcacctgtaatcccagctattcgggaggctgaggcaggagaatcgcttgaaccaaggaggcagaggttgcaatgagccgagatcacaccactgcactccagcctggacgacaagaatgaaactcggtctcaaaaaaaaaaaaaaaatgttgatttccaagtcagcagagccctggcaagcacagagctagacagaacgtgctccccagccctgtctagttctgattaaaccatgtggtcatttcatttacaggaggctgggagcccttgggacactgtggagacaggagcaggccccctgctcagggctgcccctgatcagttgggtggcctgaggcaactcctttccccgcttcagccctcaactgcctcgagtcctgtgatggtccagggaatctcttttgggcacttcttgctctaagacctgaaagacttttgtcactaagagagaaactgtcttctgggactggacattttgactccaaggagacaaccccaggggccaacagccccagctgtgacccccaggcttccacatgaactcacaaaggagaggccctcattcttgccttaaaactgcccctaaagccaagccttttcactgggaagccctagctgcttaccttttggatactagtgagtgctgcttttttgtatactcatggggctgattgcaccatagctgagaacgtggaatgcagaatgagcccacctggctttgaatctgggccctacttaacttatcagctatgtggttttgggcataagccactttctctgttaagttttctcatttgtaaaatgtgggtcataattctgccttcctctaggggaagcttttagaatagtgcctggcatgaaatgcctatgaatgtctcagttagtgtgtgtgtgtctttaacttgcgtcccattctcagggcccccacatcagtgtctcgtttacatctcacacagtgaccctgcgaggcaagggtttgcccagtttgcagatgagaaacccaaagctgagagaggtgtggggaaccgcccaaggtcacccagctgtgaatgaacgtggtcagaacacagaatctgagttggtcacacttcccactgatccatggggcctttaagccctctggaagcttccattaaagatgattatttgaggataattgtattgggatgcctatgatcttatctagggttttcctacccatccccaacattcagctcagctgcctctttcttgaggacaccctcactgatcaccccagcccagccagagtggttgctcctgctcctgcccctgaacctatgacatacccaagtcccaatactttcgagccatctgccactgccttttgacatctctgccttggctagattcaaatggtgtttcataataaaagtctgagtttaagcagctttaccgaaaacgcaagggaagtttcattccatttatacttctccagaccccctgccatcctctgctgctacccacacaggcagaataaaaggcttaaatgtgtaagtcccatgaaggcaaagattggtctcttgtgttcactgctgtctgtagtacttaggatggtgttggcccagagttggtgtttgattaaagtatctgttgaattttttagatgttttttatcacttgaagggactgggtgtggtggaagggcctgggggtgtatcccagtagatcagagccccaagttagaaatcgtgcctcccagataaccagctacttctgcaggctacacagtgttcatttgtgaagacagaggcagggagcaggtggcctaataactaggccgtctcaggtctcctccagctccagcatccagtgaatctggaattaacctttgtccttgttttaatttcttcccggttttggtccttggccctgtacttccacgttttcttttgtttttggagtgagccagtagatgtttagtttcttgtctgttttacacagctcccgcttatatggatgtgatcagactcctcatgccaatatctttccaaactagtaaaagtagaccctttgaccactcacttaccaatagcaataaaagcttaatgctgtctctctagggacactagtgagcaaatcagacttggtcaagcccttggggagcttacattgtggtgggagatggaataatgatcactttgtaatggtgcagtgtcaacctggaaaaactgcgtggtgctgggatggtgccagtggggatgggaagtgtcacccgaagatggagacctcagggaccaaagtggaaatcatgagtgaataggggaaggaaagaaagttccaggcagagggatctgtgagaaggtggcttcgtggtgtgtaaaaagagaaggttaggggttctgatcacccaaaccatgccaagtcttgggactgtgggcctcttaccattggggcccaaaggtgagctaaggggcgggttcccggccaggtagcaagaacagccaacccagggctctacctgggctctggtcctggccctcggtgggtgggctgtgttttagcaaggcccttgcgggtttaagcaatagtcacatcccttcagatgaatggaaatggcatttactgtgtgagtggtgtttattaacatttattaagtgtactcttgctaaacattcttaaatgaattaagcagtattcagcccgcccagcagcactttgaagcacagatattatttaacagataaggcagtggaagctcaggaggtttcatcacttgcccaaggctgcatagctgtgaagggcagagctgggtgtaagcctaggtcaatttggagcccaggaccctattaatctggtccatagctgcccagcctaggacacgactaaaggcattcatcagactgacttgctgggtggcaagaaactggcccagtcttgttttcttaggcccccaggaatgcgagggtgggcagaaagagtcgtggtggctcctaccccatcgccgccccatcgtggttagattataatggacgcattcattactgccatcctcaggaagcttcaactgtagagcaaggctttgcggggccctgccatgcacattgtggccatccaggagccagcagcaaccctggtgatctggtcatcttgtctcttacagacaagtgatgactgcaacctgttctcctgacttgacttggctcaaaaagcctctgcgactcacctgcttcttttgccaccatgtcctcttctgcccaccctcacattcctggtgccctaggatgacaagattgagccagtttctttaccactcagccagtcggcctgataactgcctttggccgatccctagactgagcagctgtgggcaggatgagcagggtcctgggccccaaagctggccacttctatgtgaggagctacttgtgccacattcctcaagtgcctgtcagctggcgggctcttggggtcccatggatggagtcttctgctcatatgtcacaggcaattcacaggcacctgctggcccaatcatgacctgcggtggctcagtgtgagccgcatgcctcacctctgtgacagtaggcaccgtccagtgaataagtccacttaatggttcatctcaaggaaacagtcctcaaacaaaaggcttggtatacggtgatgttcactgcccagttaattatactggtaacaaacccagcccctaagtagccaacagtaggggctggggaggtctgtggaccgctcacctagtgggctctttgaaagagatagcagtgctgtttacaaagggtcaacatgttccatgtttctgtgcctgttgtacaaacatagaaacatgctttaacttggcacggccatgtggacagtgtgtttatagctgctacccaagcctcccttgggtggaaatcatgatggttatgtcccagcacaagctgactttttctcttctactttttagtgtgtagaagtttgtggccgggcgcggtggctcacgcctgtaatcccagcactttggaaggccgaggcgggtggatcatgaggtcaggagttcaagactagcctggccagtatggtgaaaccccgtctcttctaaaaatacaaaaatcagccaggtgtggtggtgcgcgtctgtagttccagctacacaggaggctgaggcaggagaatcacttgaacctgggaggcggaggttgcaatgagccgaggttgcaccattgcactccagcctgggcgacacagcaagactccatctcaaaaaataaaataaaataaataaaagaagtttgtaaggcagggtgcgatggctcacgtctgtaatcccagcactttgggaggccgaggtgggcggatcacctgaggtcaggagttcaagaccagcctggcaaacatggtgaaaccttgtctctactaaaaatacaaaaattagctagctgggtgctgtggcacgcgcctgtaatcccagatacttgggaaactgaggcaggagaatcacttgaacccgggaggcagaggttgcagtgagccactgcactccagcctgggcaacagagcaagactccgtctcaaaaaaaagaaatttgtaaaagcgcttcctggtttcaattctaagcactatgaatgagagtctctctttttttggacaaaaaaataaaaacctgattttgttagttttttaaatctgtgtccctgcatgaatcagagctagtctctccttttactgctgggaaccaatcagccctgggaaaggaacccaggagtgagccagcaggcctgcatgtgaatcctggccccactgtgtgactacagacaggtcgcctcatcactcagagctcctgttgcctcatgggcgaatgagatggtgttgccacccacagagtagttctagggcatggcactggcatgcttcgggtgctcagcaccatgcctgtcacatagcaagccctctgcggatggtggcattgactgagaactgctattccagttctccccaattaggggtgtgggtgggagctcggcagaaggggctccacatcctctcagtctccgtctgctctcccctcaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccaggtaaggggtcttctacctccccatgtaggaacagacctcatggcacattctctgtggctcatcaggagtcctggcacagtggtgtctccagaggatccaagcagggcccgaggagttgaaggaattgggttgttgcctcactgcctagccagcctccagctggtgtcccatagcagatcctcccagggaccggccccagagggtaaccccagtctcctgagatagacagacacgtgagcatcatgtgtgtctccccttccttgataggagaaaactcaaaggcatttgggacatagaggagggtgtggccaggcctgtctggggctgtctgcaaaagcttcccagaagaggggacactggagctgaatcttaagggcaccaggaagcagtgtgagcaaggcggaggggcggaaagccacgtttggaagaatattcagtgattcttctccaaaatgtaaagcaaaagtactgtatcattttatccttgaaaacatgttctctgcccacttgtaaaggccaggcctgtctttaggccccttacagccagcttttcctgccgcacgggagcagattgctttgtttcctttacgcgaggtgcttgccttgcatttgggggctctgtggtgcaaccaaggcctgtgtttagtccttaggatcattctcagggtgaggagatgctcattctgggaggagcccacaaggatgggagcacaggagcgagcaacagagccacatctcctgcccggctccctcgctctcactcatggactggggtggcaggcagagcctccagggccgtctttgcattattacttttttctcactctgctttttcttggctgagccacatagttgagtgtgcgtgcgtcacgtatgcgcgtgatggtgcactcccgctgcagtgccgcttatctagggcatcaggatgtgagtggggaggagtgggaggtgaggctttggtccagtttagaaggggccacaaacacctaactcagttgcatggacttgatcttgcaagcagaggtttttagggcaggaggtgataggattatgattaggacctggataaaggaaggcagtggggggtctggggacactgaatgctctggactggcaacacagagggcaaggaggctggccacagagttctgaggtaatttgatgggaggtcagccactccctgcagcagaccagcataggttctgtcaccaggcctggaaggatgggcaggaaagaactatagagccagtcacagcagcccacaggctccctgggacactccctagaggggtggggacagagcagttcagtcacagagaagaacataagaataactccagagtctattattccaaaatcacgcttctgtgtgtaatgcctgatccatcggggagaaaagactgcaggaggcacagaatctgttttcccagctttgcttcccacaagcatgaccctgggcaagtcgcagaacacctgcaaatccacatctgtaaagtgtcgagtaggggactgtgctgtgctgatgtcctgagccaccctgcctggttgagtgtgttgacctgggttgggggaaaaagccttggaatcagatttaaactgcagttcctcccaggttgtcatgttgtgtgactgcagaggacaaagcttcactccccaaaagtcgggccgggatggagcgcagtggctcacgcctgtaatcccagcactttgggaggccaaggcaggcggatcacaaggtcaggagttcaagaccagcctgaccaacatggtgaaaccccgtctctactaaaaataaaaaaattagctgggcatggtggcgcacacctgtaatcccaggtacttgggacgctgaggcaggagaatcacttgaacccaggaggcggagcttgcagtgagctgagatcgcgccactgcactccagcctgggaaacagagtgagactctgtctcaaaaaaaaaaaaaaaaaaaaagttgggccgggaacagtccccctgctcaccctgtgcacagcagaccttgtgctccccagtggcccactgggagttcagggtatgggggaagggagcaaattacttggtctccaaatcagacaaattctccacagacagtgtcccttggcataaagctcctgagaatgtctcctctggaaggacagtgtcatctgaaagctcctggccattcaggtctcaacttggcagcggcagcgtctccaatttggccctgaagacccacaggcattcagagcccatgactgtggttggtgcttgagtccagaatgggcagctcccaagtagggggttctccttggggttcacaggcctggagatcccacaaccttgtcagtggaggaggatgaggtggccagtccctcaccttggcagcactgcagggggcgcccgtgctctcaagtcacactgtctctctcccacacacatgcggcgctgtgctggaggacggtggcgcgctgagcttgtcttacagagcatgcttctttggctcagcctcactgctgccactcaagtccttcctcgtcaccaaatgcttacctgcatttttaaggccatctactccacttgagagtaagttctatgagggcaggggcttgtaagcacatagtaagcatctagcaaatatccattgattaaataaatgaatgactctgtaaacctccctccactgctgacaccccactgatatgggtcagaagtggggtcagcagtggggacggggtcagggatgtctgtggggcatagttttaggatgaaaaccagtgatttgacactttgacatacccacttttatgtggccaagaaaaaataattgggttttggtgccagaactcctgtggtcaggagccaccacgcagagcctaggaggccctggcgctgaattgcctcaggatggctacagaacacaggacccaggggtggccacaggcgtagagcaggcctggctgctgctggaagtgcccgtttgagactgtagttagcaccctacacatcgtgggcagcctggagcagcctggcccgggagggagatccatgccttcccacctgcctgacctgaccccatccagctgaggtactgcttcccaggctgcagacagcagcaggtgttccagacagtgtggctctccacatgtgtgccacattcaccccaccctggcccagaaccgcccacgtgaacaggcttttttttttttttttttttgagacagggtctagctctgttgcccaggctggagtgcagtggtgcgatcatggctctctgcagcctcagcctccctagtatactgctgggaccacaggcatgtgtcgccacacccagcatttttttttttttttttttttttggtagagacagggtttcactatgttgcccaggctggtgtcaaactcctaggctcaagcgattctcccacctcagcctcccaaagtgctgggattatatgcgtgagccaccatgcccggccaagacattttaacacaaacttttgttagctggacatggtggcaccagtattcccagctactcgggaggctgaggcaggaggatcgcttgagcctgggcagttgaggctgcagtgagccatgatcacgccactgcactccagcctgggcaacagcgagacccagtctcaaaaaacaaaacaaaaaaaacagacttctagttttcacttattaacttcactagtattaaagctgaggtaactaactcagcctacacaaccttcaacacacactacctctcacaaagcacctgaagtggtattgttgcatttagggcttgatgatttggagtaaaagacactgatgttaccgattgtgcctatttttatcagtggcttgttaattatttctgttttcattagtgatttttatgtatgcagattggttagccatgaaactgttagtcacttcatttctgtttcttccctgttgcaacagcccatcttcgtgggaagaaccaagctttaggcttggctctgaacagccacaaagtgacttggctgaggtcctgccatttcgctcatgctcagcagggggcagcagaccagggcagttcagagtatggggtcaaacccaggtccctgtccccactccacctgtggatttaccctggattgggcaagccctttaactctctgaggctccgtgttctcagagtgactcgaggattcactgaggtgccgtgtgagaagtgggtggcccagacctggacacaaagaagccttgatcaatgtttgcagtttgattaagtgggtaaatctgcatatataaaaatcactaatgaaaacaaataattaacaagccactgataaaaataggcacaatcggtaacatcagtgtcttttactccaaatcatcaagccctaaatgcaacaataccacttctccagttacctcttcagtgaaacgggaggcactcaggctcacctccaaggacttggacttgctgtgatttaatggtggacattcctccttacagggccagatccctggagctggaatccaggctgctttgtcccattttgaaattttcttattcagaaggttctggaaagccaacaaattgagtttgtgacagaaattgacattaactggctgggtgtggttgctcacacctataatcccaacactttgggaggctgagacaggaggatcactcgagcccaggagtttgcaaccagcttgggcaacatagtgagaccccatctgtacaaaactttttttttttcttaatggagtctcactttatcacccaggctggagtgcagtgaggcgatctgcaacttctgcctcccaagttcaggcagatctcctgcctcagcctcccaagtagctgggattacaggcacctgccaccaagcctggctaatttttgtatttttagtagagatggggtttcaccatgttggccaggctggtcttgaattcctgacctcaagtgatctgcccaccttggcctcccaaagtgctacgtgagccaccacgcctgaccttctacaaaaaactttttaaaaatttacccaggtttggtggggtgtgcctgtagtcccagctacatgggaggctgaggcgggaggatcacctgagcccaggaggtcaaggctgcagcgagtcatgatcgcaccactgtactcagcctgggtgacagagctcttgctctgtctcgcggaggggaaaaaaagagagagagaaaaaagaaaatgacattacccaagtccagtgaagtatgtcggaattccatctttgacactaagtagctgggtaaccttaagccagtggtcctcccacagcctacaacatcagcatcacctgggaacttgttagagaaatgcaaactcttgggctttgccccagccccactaaatgatggttctgggcgtagagccctccaggtggttgggatgcctgctagcttgacaaccatggccttaggcaattcattggagctctttgaactggagtccccccacctggaaaacaggggtgagaatcctgcctacctgctgccactgtcgtggggaggattagaagagacgacacactgtagagtgcccgctgcccggtatggggaggcccctcttgcaggagcccctgcaggaatcttaaaggtttatcttccgttttcccagcatttggagatgctgaacgttgatgctttttgttgctttctccccttcctcattttatggttagtgatttaatggtttatttgctttcttgtgtgtttttctctcattttacatttagtgattttttttcatttttctcttttgcagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgcttacccgtctgttgtgtctttaaacactaggttgaaaaggcctcactcttcctgtgtaatcacacgtcggaggcccggttgcctcctccagccctggtgggagatgatgttcatggtgtccgagaggcctgctgcttcttgtgcctgtggccatacttagtgtagcttggtgtataattggtgctctggtttctgggcctcttggccctagtccttcttttactgtttcccactgctgccagtgttgaaagattttttctactatgctgcactggggaagagagtggtacttactgaggacccggaatgcacctggcgtgtaacatacagtagctctcacctcacggtaccatctgtagacagagtgttagggccacctcagacatggggacttgggtttagaatggcttacctacgccctcacagccaggacacaggtctcagactcaaatagccttgctcttcccacactatctgccccagaaatcctggagggcccccgttcacccaagtgagcctgtcctgggcaaacatctgccccgcagacttggagcgcaggggtcctctcgccgagtgcttcccagaattcacctgcactcagactcccacccacccctcatccagccacactcttgtttttttccctctgaaaccacatgtatttaattttattagggtttttctttttatcttttgtttcctgttacacaggaaaaagactcggcaccgtgtagtgtgagcctggaaatccccgtccttgtcctccctgccccagaagtcaccactgtctgtgagttcttccatctagcaatcataattgcccagattttccagtgaggcttcctcaatgctatcggaggagtgaaatacatactctttggagttgaggggtgtagtttataagggcgtggcaaaatttcttcaaaagctactttaatgaaagataataggcattttccactctataatatattcgtgattatcttaatataaaaataaccctctcaaatagttttccctgaatcttcaagtaacgttggttgtctgagaaacactctggtttcccctgtccctgcggacctaggaagcgccccctgagagtgggtgactgcagaccccacgtggtgattctctgctaagttccgtgctgcagacgaacgtggggtgtggccagcagcgtcacccttgtgttctcggaagctgggatccaagtctgaggctcctccgtccttctgcttgaatttctccaagaaggataatggggaaggaggtcggaggaggagaggtcaggtttctaggacggcgatcgggggtctgtccctggagggaggaggcgttctggctccaaagcaagggttcagaatagggctgagggcctgtcccttccaccttcccttagtccccctagtactgcctcttgtttgccttaaagttccccatcctaaaagcattccatcaaagtcttggggaaagtttcttatgaaaataaagatgctccacttcccagtcccttgagcaccaggattttgtacatcaggagcccaccatgtacatcaggagtttgtaatgcagcaaggcaagcataattccttggactcaagatgtaaaaatctggctgggtgcggtggctcctgcctgtaatcccagcactttgggaggtcagggcaggattgcttgagcccaggagttcaagaacagcctgttgcgacatggcaaaaccttgtctccaccaaaaatatgaaaattagctgggcgtggtggcacgcacctgtagtcccagctgctggggaagctgaggtgggaggattgcttgaggttgatgctgcagcgagctatgcgtccaccactgcactccagcctgggtgacaaagtgagaccttgtctcaaaaaagatgtaaaaattcatggccacagagaaggtttacagcgggggaaaaagaggttaaaattaagttttgttttttgttttttttttgagacagagtctctctctgtcactcaggctggagtgcagtggcgcgattttggctcactgcaaccgccacctcccaggttcaagtgattctcctgcgtcagcctcccaagtagctgggactataagcgcccaccaccatgcctgagctagtttttgtatttttttgtagagatggggtttcaccatgttggccaggctggtctcaaactcctggcctcaggtgatccgcctgccttggcctcccaaagtgctgggattacaggcgtgagccaccatgcttggccaaaattcagatttttaagaatctaaataatggtattccacatacaaaaaccctagtgtttctgtactcaaaagtagcgtgtatactgtcaaggttagaaactgacagctgtcctaggcctagagggaaaagcatgggttctgagtttcagaaggacatttgccaatatagcaaaggtgtgcccacacccagtatttttttatgaaaaatttcaaacctacagagaattgaaataattgtatatcttccatctcaattctacagttacccattttgctatatttctgtatcacataactttccattcttccatctaacttattttttatggctttctaagtatattgcaggcagtacccaccccaagcactgccaagtgtgtatcattaactagtttgtttactgcttttggaggatgggtaagatttacatagagtaaaatgcacagatcttcaaagtgacaaatgtgacccctgtgtaacctcacagccgtttcaggaaagctgctgctgcttcccagtcggcccagcccactccccagaggccaccctgttctgatttcctccaagtatgatttctgccctctaaggtacagctctcacctgggctccgtgagcagggccggcgtttcagggaagtggcagcttctcgggaggtgccgcagctgccatctcccgtcagcactcatgcctccgcctcagccctggccacggctccctggaattctgatcctcctctgtgagctggtattgctgtttctccaaaaattaaaaatgctcaaaggattataggttttctcctctttcgtatgtttggctctgagacactgcatgttggcacgtttttcattgagaatcctgaaagccacctttccataccaaattcccatctgtctctaccaaattaccagaaaaagaaaaaatgagaaatggaggtctcagattccgtcatcacagcaggtagaaatcaaagtcactgaatccatcaaattagtaagcataccccactgtcagtgaacttcagctgatcagttatgtattgagaaggcaaataacacaattgcagaacatgttcaaaatactagtcctactgctatggtgaacaagctcaatccaatcaaaagcacctttattttggtctctcactgtctaaatttactctctagggcttgttctcccgctgtccctaggtgagatgtagagcaagccctgccctgggcagatgaagtccccgcccaacacaggaactactccttccagccgcgtttggagagaggccgccccttccactgtgggcccgcggggaacctcgctctctgcagggggagagcagcttatgtttggcctcggccttattttatttgcccacttggtgctgtcagctctctttcccaagttgctgagaggggcatgaggtggggagcagaaattcatcgttcgccgatactgctgtgaactggcttcggccgtggtgcattttcatgcgctttgacacgcatgccccctgccctcttctgttggtagctccctcactttgaagggtgcgctccttctggccggccctatctttggctcctggctgtcggggtctcccctctacacactctcttctgttgagtcgtggtgaagcagaaaccccaccgccttcctccatgggttacgataagattcatagcctctcggtggcctctaaaaatcttcctcgaacttccagctcctttatagaccacattcccagcagaagtgtgagctcgcttgggaccacctggtgtcacagtccaggctgctgctggtcctgctcctctacgtggcaatcggcccagagaatatgccttggggggtctcagcagaaactaagatgaaggtaattcaacttcaactccctagttcacaagaaatacgttagctgttttccctaaaaaaggctaggtgaaatagggaatttcatgattttttgtggggggcagggggggtacacaatctccctcttttcacccaggctggagtgcagtgagtggcctgatctcagctcactgcaacctctgcctcccaggttcaagcaattctgcctcagcctcccaaggagctgggattgcaggtgtgcgccaccacacctgggtaatttttctgtatttttagtagagacagggtttcaccatgttgctaaagctgggatccaactcctgggctcaagcaattctcccacctcagcctcccaaactgctgggattacaggtgcaagccaccacgcctggcatatttgatttttaaatactacaagtatttgggtaaaaattaaatttaaaaagtttgcaataacctaacaacaggctataatatgataagccaggggcttcccagcccttttctaatgaagtaactgaagaatgaggagcgttatctagaagtcagggcgaatctgccagagtcaaccaaagacagccccctgcaaacatgaacctgctctctagaaatgtacacaggtttgcgtcccggtggctccggggagaatgtggagccgagtggagtcaggagcgcaggcagccaggggagaactgatggtggcttgggcaagggcggtttcatggggtcggaaggggggattctgaagggagaacgccaggacttgctggggagggttggaaagtaaggaaatgagacatcaaaggagactcctccatgcctgcttgggcaaccaggtgctgccatttactgagaggaggctgactggggacctttgtggggaaagagcaccagcaatttggaaatggcttaatctgagcctgtgagatacccatgtgtttagaaagaatgtcggatggactgttgaatacccaactctgccaggccttgctagacataaggatatggagctatcagcctgttactggtatttaaagccaagaaggttaggtgcagtggctcatgcctgtaatcccagcactttgagaggccaaggcgggagattctcttgagcccaggagttcgagaccagcctgggtaacgtggtgaaaccccatttctactaaaaatacaaaagacagccgggtgcgatggtgagtacctgtagtcccagctacttgggaggctgagatgagaggattgcttgagcctggcaggtcaaggctgcattgcgccactgcactccagcctggccaacagagtgagaccgtgtctccaaaaaaaaaggttgtggaggctgggcatggtggctcacgcctgtaatcccagcattttgggaggccgaggcgggcagatcacctgaggtcaggagttcgagatcagcctgaccaacatggagaaaccccatgtctactaaaaatacaaaagtagccaggcgtggtgcacatgcctgtaatcccaactactcgggaagctgaggcaggagaatcgcttgaacctgggagatggaggttgctgtgagtcaagatcgtgccattgcactccagcctgggcaacaagagcgaaactccgtctcaaaacaaaacaaaaaaagcttctggagccccagttatcacgttcaagttccagatggcagctgatggaggatggggatggcaaaggatgtaccttttccctttaaggcaatttcccaggagtcccatagggcacttcctacttaggcctaattaactgaagttcagccacctgccactcctgactgcatggaagccaggtgcaaggagaaaggattttgaggaggggtgagtcaccagaacacatttgtttgctgcggagagatcgtaaggggcctcggagcaagtccatggggcgtgaggagggctggcgtcctgcgcacagtggaaggactggccttaggaacagggacagtgattccactcagcatagccagggagcggcccagatggcagggcaaggtctctgtggagtgagggcagcagggaaggtgcctcgcaggagaggagagaaaacatacacttccctggggacgcgggcggggagtttgacgggttcggcaggtggcccttttgcagcatctttttcagccgggggtgcagcagtcaccatacagctgaactcggccaggttaaggcggcagaagaaagagggagttgggacttttggaagtaattatgatggctgtggagtctgtgctgggtgaggaagggaagtgactggatagagggtggcagtggaattttttttttaattaaaatttttttcttccccaaccgctccccaccttttttttttttttttttttttaaatagagacagggtctggttatgttgctgatatggtctggctctgccccacccaaaatctcatcttgaattataatccccataatccccaggtgtcaagggagagcccaggtggaggtgattgaatcatgggggcggttcccccatgctcttcccgtgatagttctcacaagagctgatggtttggtaggtcctcctgcgttcattctctctcctgtcgcctagcgaagaaggtgcctgcttccccgtcaccttcctccaggattgtgagtttcctgaggcctccccagccatgcagaactgtgcctcagttaaacctcttttctttgtaaattactcaggctcgggcagttcttcacagcagtgtgagaatggacaaatagtttcccaggctggtcttgagctcctgcggcctccctaaacgctgggattgcaggtgtgagccaccgcacctggccagaatgaaactttggaaggggctgattgttcagataggcgggggtcagtgtgctcggccttgcttctgcaggggaggcacactggtgaggtgccctctagggcagacgagggaggggggttcccggagcagtgacggtggagacaggtgggacgacacagatgggcttgagaggactcaggactgcaatggcaggtgagggggagtccacctgggcctggaccaggtgatgggatgagaagggagggggcgattagctagaggcacaggcttggggaaagagatgacttcctttggacgtgttgagttcggaggcagcctttgttccagagacagagcctggacctgacagctggaagccaaactggaggtggggattgtacgtcactcatagtggaggcactggtgggtgtggagagaacccaggaccccatgagtggctggaggctgcgaaggccgcggggagccaacctccccaggtgaccagaccgctccaagggcttgaggtcacggagggagaagggtggcagccccggccctctcactcagggaggtggagttagagctggagaggcctgagcacgcccctggctcaagaggaggacagatatgcgggtgaggcccggaggaagggaatggccaggtctgaggccctgcatgggctgtggggttggtgttctcagcctccacttttccagtgaaagcagaggatctgtggggagcaaggtggggcagtgtgagctcgaggccggaggacccctgagtgggtctcagtccctacaatctttggagtgttccccttcgctgccttttttttttttttttaaagatggagtcttgctcttgtctcccaggctggagtgcaatggcacaatctcgactcactaaaacctccgcctcccgggttcaagcaattctcctgcctcagtctcccgagtagctgagactacaggcgcccgccaccatgcccagctaatttttgtgtttttagtagatacagggtttcaccatgttggccaagctggtcttgaactcctgacctcaggtgatccacccacctcggcctcccgaagtgctgggattacaggtgtgagccaccatgcccggccccactttgcttttttggttgtggttttttggttttgtttttgttttgatagtctctatcacccaggctagagggcagtggtgcaatcttggctcactgcaacctccgcctcccgggttcaagtgattcttctgcctcagcttcccaagtagctgggattgcaggcatgcaccatcatgcctggctaatttttgtatttttagtagagaaggggtttcgccgtgttggccaggctggtctagaactcttgacctcaggtgatcagaccaccttggcctcccaaagtgctgggattacaggcacgagccaccatggtcagccttcactttgagtctgtaaacgggaactgccaatccttcctcggagataatgaccctgactcagacttcagcccacgtgtcctcccgatatgaggcccatttttacgagttcatcaccttaaacgaggcgccaagtcacagcggtgttgatgcagggcaggttctttgcctggctcaggaaggaattcaagaaccagccggtggtagaagaaaacagcttgattgatggggtggcacgttacggctgtgactggccccgccatgggcagtgtgctgagagtagcagcccagggacagatctgaatccgtgcttattcccatttttaatgacatcctaattcagggggcgggttattcagaaatagctagaaaatgggcggtaacttttgagtgttgccatggccagaggtggtaacttccaggtgttgccatggcaatggtaaactgccatggcactggtgggcgtgtcttagggagaggtgatttcagcacttctggttcagccagtcttcaatctcgtccagagtcagtccctcctgcctcctgcctccgtgctgattgcaggccctgtttcccccaggactccatggcttccgagttgctgactgaccctccacctcagaggtagttctgacactgtctcagttttgcagatgaagatgagattcttcagttctccatgtggaaaagcagctgtggacccaggtctgtctggcccgcctgccgttgtgtgaaggagctcagggcctatggtctgtccacactcgcggtcatcagtggccaagcaggccagggttgctccgcccgtgtgccaggccggccaaggccagttctccactttttctcaggcccatgggtccaagtccgaagccacagaacggcaggaatgaggggtgggagcagagcagtcgagggtgcgcttgaccgtggctgagaccccctgagcagaaacgactcccccaacctctgctgatcctcctagcacccagcagcagtgcttggcacagactctgtccctgcgcatggtctagagggggagatagaccttctagatggcaaacggcatggagagatgactgtgggggcctgggggaggggtcacttatccaaataataattactgagcacccaccatgtgccacactctaagtcctggggtgtagcaggaaccaagcatatgcagaactgcccttcaagggcttgcactttagtgagaaggaaataaaattttataatattaaatgtaaaaccacagtgagataccactacacacccgccaaaatggcgaaacgaaaatgaacaccaccaaacggtggcaaggaggcagcgcacctggaactcccgcacatcgctgatgggagcacaaaatggaacagcactgaagagaggcctggccactcctcaaacacacacctgcccccaaagccagcatatctcctattcgtccaagtgaaacaaaagaacatatcccttaaagtataattaaaaatatatatatatccacacaaacactgtcacagaaacgttcagagcagttttattcacaatcaccaaaagctggaaacagcccaggcatccatcaatggaaaaactgctacatccatccatgggaacctacttgatagtttaaagaaatggcctacttgggcacggtggctcatgcttgtaatctcagcactttaggaggctgaaaccggtagatcaggaggtcaggagtttgagaccagcctgggcaatatagtgaaaccctgtctctactaaaaatacaaaaaaaaaaattagccaggcctggtggcatgctcccgtaatcccagctactcaggagaccaaggcaggagaatcacttgaacccagaaggtggaggttgcagtgagccaagatcttgccactgcacttcagcctgggtgacagactctgtctcaaaaaaaaaaaaagcctactgatacctgcaacaacatgggtaagcctcaaaacttcatgttgaattaaaccagaggcacaagaatacatgccgtatgattccatctagaagaatttctagaccaggccagaatatggtgagaaatgagaataatgattgcctccatggggcgtgcaggtagactggtgaggcccaaggaaccttccaaggggaacgctgtccttttttttttttttttttttttgagtcttgctgtgttgcccacagtcaggctggagtgcagtggcacgatttcggctcactgcaacctctgcctcctgggttcaagtgattctccgattcaggaggtagctgggattacaggtgcctgccatcacgcctggctaattttttctatctttagtagagatggggtttcaccatgttggccaggctggtcttgaactcttgacttcaggtgatctgcccttggcctcccgaagtgctgggattacaggcgtgagccaccgcgcctggccatgttctctatcttgaaaggggtttgggtcacattagtgagtgtacttctcagactcaccaaagagtacacttgacacctctgcatttcattgtttgtgaattttaccctgaaagaaaaaaaaccaaatactgacatgaatgtgaaagactgaggagaaagtgaacagatgtctgcaacttactctgaaattcaacaaaaagggaaaatggacagagacgtaataaagcagatgaagccaactgcttttgagatggaatctcaaaatctctgtcacccaggctagagtgcagtgtgcgatctcggctcactgcaatctccaccttccaggttgaagcgattctcctgcctcagcctccccagtggctgggattacaggcgagtactgccacacccagctaatttttgtatttttagtagagacggggtttcgccaggttggccacgctggtctcaaattcctgacctcaggtgatccacctgccttggcctttgaaaagtgcttgggttacaggcgtgagcctctggacctggcagagccaactgttaatggcagaatgtaactgggtgtaagagggaccactaccattatttcaagtgtgtttgaacgctttcataatgaaatgcccagaaaaattatacagcatattggaaggcctccctgaggagacacttgaaccaaaactcgaggtgagggtgtgagggacacagagatcccggggaaggatgttccaggcaaaggccctggggcatgagcctgacagggattcctagagtagccaggaggccagaggagtagcggggaggcagatcccacggcctcctgggccaccatccatcagcccttggctcttactctaagaggggtatgtggggacaggacagctgtggtcactgtcctgagagcggactgaaggaggcaaggccagggcaggaaaaccagcaaggagacaatagcagcagttctgcaagatgtggtcggggctctggccctggtggcagtggcggccgtggtgtgccatggtcagattctggagaatcttgaaggtggaacagacaggatttgaggatggactgggtgtggagcaggagtggtggaagggggtggtaaaggaaaggaaggagtcaagaatgactctgaggaggccgggcacaatggctcacacctataatcccagcactttggaagcccaaggcaggtggatcgcctgaggccaggagttcgagaccagcctggccaacatggtgaaaccccgtctctaccaaaaatacaaaaattagctgggcatggtgacgggtgcctgtaatcccagccactcgggaggctgaggcaggagaatcgcttgaaggtgggtggcggaggttgcggtacgccaatattgtgccgttgcactccctacctaggtgacgagcgaaattgcatctcaaaaatgaaaaataaataaatgaaaaaggtttttggcctgaaaaggggagacaaaagattccaactggagcacattttaggggaagatcatgggtttgttgtgcacaggtcaagtttgagatgtctgtcagacattcaagcagacacatgaagtagaggtcaggccactggattcaggggtgatggggcaggggagggactgaagggcgagtcagccctgctgactgtcaggcaggggcagagctcacagcttgggacttggggccctcctcctccacgttggcctcagttcagggctgagtctgacaaaagacaggtgtaatcactttccaaggctgacccagttctttggctgctctcagtgggcctggtcacatttaatcttctgtggcactgtgtgtgtgaggtttgtccagtttgacacacagctctggatcaaaagtcggcaaactaaggccctcagttaagtctgtttgttttggcaaataaagttttatccagatccagccaatctcatttaggctgtctaaggccactacagcagaaccaggtggctgccagagaccacatggcctgcaaagcctaaaatatttactgtctggccctttaagggaaacatttgccgactcctctccatctttcattaaacagggtgtggttctgttataggaacacacagcaagctattgaataagacatttaggtggttcccaactttttgctattatgaaaatgttacaataaacattcttacccttgtttccctgggctcctgggcacacacagtggaattcctggtgtgtaggaaagacatgggcatcttcagtttgggtcaattttgccaaattgctctccagtgtagctgaggtcagttacactcccagcagcagtggaaagagcccatctttccacgttcctctaaacttattacctatcaggtgtcctcagccttcagtagttaccagtctttcactgtgtgtagattctcttggatttcctggctgtgagtgacaggtttgctctttttttgtcttggtgctctggacccctgtacaatactgaattgtctttactagccatttgttcctggcttttaagagaatatttcatgttttaccacatagtatagtgttttacctttaagtacatgtttactatacgttgggtttttttttttttttttttttttttttttttttttttttagacaaactctcgctctgtcaccaggctggagtgcggtggcgcgatctcggttcactgcaacctccgcctcccaggttcaagtgattctcctgcctcagcctcccaagtagctgggactacaggcatgcaccaccacgcccagctaatttttgtatttttagtagagacggggtttcaccatgttggccaggatggtctcaatctcttaacctcatgatccgcctgccttggccgcccaaagtgctgggattacaggcatgagacaccgcgcccggcctgtttttgttttttgagatggggtctctcgctctgtcgccaggctggagtgtagtgacacaatcttggctcactacaacctccacctccctggttcaagcaattctcatgcctcagcctcccacgtagctggactacagacacgtgccaccatacccagctaatttttttgtattttgtaatttttgtattttgtattttttgtattttttttttttgtagagatggggtttcaccatattgcccaggctggtctacaactcctggactcaagtgatctgcctgccttggcctccccaagtgctgtgattacaggtgtgggccaccacacctggcctattttttgttgttgttgttttttgtttgttttcagcattttttgttgtttttctgagaaagggcctctgtcactcaaacgatccttcctgagtagttgggactataggtgtgtgccaccaaagccagcgaattttcttatttttttttttttttgagacagagtctcactcttgtcacgcaggctggagtgcagtggcatgatcttggctcactgaaacctctgcctcccggattcaagcaattcttgtgcctcagcctcccaagtagctgagattacagaatgcaccaccacacccagctaacttctgtatttttagtagagacagggttttgccatgttggccaggctggtctcgaactcctggcctcaagtgatctgcccacctcagcctcccaaagtgttgggattacaggcgtgagccactgtgcctggcctaattttctcatttttgtagagacggggtctcactatgtggcccaggctggtctcaaacttctgggctcaaatgattttccaacctgggcctcccaaagtgctaggattacactattactccttcttaaatttctttgaaactctgctcatggattttctgtatttattatctaagtaatacatctatgtaataaggctataaatctgattttttttttttttaaagaaatggatcttattttgtcaccgaggctggaatgcagagctgcaatcacagctcactgcagccttgaactcttgggctcaagcaattctccagtctgggccccccaaagtgctgggattacaggtatgaaccaccacacctggcctgccatggcccccctcccaagttttctttcttttttttttttttttgatggagtctcgctctgtcgcccaggctggagtgcagtggcgcgatctccatttactgcaagctccgcctcccaggttcgagccattctcctgcctcagcctcccgagtagctggaactacaggcgcccgccaccacgcccagctaattttttgtatttttagtagagacggggtttcaccatgttagccaggatggtctcgatctcctgacctcgtgatccgcctgccttggcctcccaaagtgctgggattacaggcgtgagccactgcgcccggccaccaagttttcttagcatatgtatcctcattttttgtttgaactaaataatttttatttatatatgacttcatatttagaataggtttaaatttccacacagctggagcttacgcggcttttgtctgtggccaaagaatatggttgaaactgatttgatatctgttgagatttgtcgtgcaccctagtagttgggtcatttttgtaaatgttccttgtgtgattgaaaataatgtgttggtctcacacaggtctgaaatttaaattttaaaagttaaaaaactaactgtcaggttttctattggggttcattgatcttgattagtaactgtattaacatcctctatgtccttttttttttggttgtttggtttattagttactcaaagaggtcttatgtctccctatgatggaggacctggcaatttctccttgtgttcttaatatattttcagcctcttttttttttttttcgagacagagtctcactctgttgcccaggctggagggcagtggcgcaatctcagctcactgcaacctccgcctagcaggttcaagcaattcttgtgcctcagccacctgagtagttgggatgacaggcgtgcaccaccacgcccagctagctaatctttgtatttttagtagagacagagttttgccatgttggccaggctggtcttgaattcccagcctctagtgatccacccacctcggcctcccaaagtgctgggattactggcatgagccactgcgcctggcctattttcagccttaaaaacaaaaaccctggaacatagaagttcagaactttcctctcttcacagagttcctcctcgcatcatttcatgttgatcctcttatccccagtgtcttctgcctgaaggcctattttgtctgagttttctataggtacatcttttggttagtttttctctagtacaccttttcccatcgttttactttttggtgcccttaggttttaaatttcctcttgtaaatagcatagagctgcatcttattttttcttggccaatctggtcatctgtgttttaagaggtgaatgtaaaccacattttctacctctggttttgtactatatatttaccatcccttttactttgcttcctttttctccctttctgccttccattatagttttaatacccatcactacccttttctctgcattggcagttatagttccgtttgtattcttttggtgatcctcttaaatatctgaaatacacacctgactttacaaagccagacaatgctcagtctctttaaccccctctcaaattgccctctcagtcttccatgttcttgtgtctcatgcatcttgtttctgtggcccacaaattaatcattattattcatattgcatattaaatgcttgtttagattcacatgtttaccaatttgctcaccatttttccatctaatttcttccttttgggttccatgtccttgttactaaactacattctttaaaaattatttcggcggccaggcgtggtggctcacacctgtaatcccagcactttgggaggccgaggcgagtggatcacgaggtcaggagatcgagaccatcctggccaacatggtgaaactccatctctactaaaaatacaataattagctgggggtggtggcaggcgcctgtaatcccagctactgaggaggctgactgaggcaggagaatcgcttgaacccgggaggcagaggttgcagtgagctgagatcgcaccactgcaccccagcctggcgacagaacgagacttcgtccccctcccccctcccccaaaaaaatgttgatcttcagtctgcgcattctgctctggattttaagcatcatttctggcagctctttttcaggaactgtctctgcaggtctttcagtgttcgcctctggagctctgctcgggcccgcgagttctcctggcgttgccatctgtgcccttttccttattccccatcacctgtctctctggtgagctgcttccgatcagcctccaggtccacgatttctcttctgttgtccttttctgccttctcacctcatcctctgagacctgaatttcgatggctctacttttcaattatattattctttttcaaacctgggcgttcatttctagcatcctgttctatcctgtgtctgactgtgcctcccgcaccttctcccttctctcgccctaagccccgtgaaggcgccgggcctttggctccggctgtttcccacggcgcccagaaccgcgtcagtcctgacacagactcggtgagggcgggaagtggtgccgtggggctgcagcctggcccgcccgctccatcggcctagggcggccccaccgccctccgggccttaccttgagttcgggctgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcggtgaggcccggcaggcgagctgcgagctctggggcaggggtgccggccgaccccgactgccgcaggtgacgtcagccccgtgacgtcaggctctggctggaccctcgggctgggaccagctccggcctgggcgggggctgcccgcttccccaccgcgataggtgccaggggctgtggggcctgatggccccgggggtgggggctggagctggggcgtggccgggggccgcccctccgggacaggcggggcggacctgggccggcccgacccggcctcacggtctggccgctgtccgcagccgaccgctgtaaggaggtacagcagatccgcgaccagcaccccagcaaaatcccggtgagtcccgcacccccagccctgccccgcccccgcctcgcgcgttcccgacacgaccccctgcccgcccgccctgctcccaggtgatcatcgagcgctacaagggtgagaagcagctgcccgtcctggacaagaccaagtttttggtcccggaccatgtcaacatgagcgagttggtcaagatcatccggtgcgtgggcagccgccgccaggaggtggctagggtcgggaggggagccgggttcccgccgagaaggggtgggagtggggtcaggggtgatgggaccgggcggtgggcccctgttctggggtggctggaaaggtcaaggtcggggctgcagtcggtgttgggtcagaggtgacagctggggtgagaatgggtgtgaaaggctgggaatcattctgggggtcagggctatgtccgtcccgcagccaagcccctcacagctgcatactctcccgccggctgcaggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggccctgtgcctccagccgcttgcttgggagtggggagggtgctggtggggctgcccgcaccatccccgggctctggcgcacagacttgtgttctgtggccgcggtgctcgctctggaaacccacacctgtgtgtagtgttccagaacattattaggggccaccccctctaggagtgcaatgcagatgtggtctcagggtagacttcataacaaaaaacatttattaagtagccacaatctaacaagccctgctcacctgcctcttctccttcctgtctgggagggggctccttggtgtgcagagccacaaggtgggggtccaagttggggagctcccagttcttccccataggccttgctgtcagtcagccatgggtcccttttggtaccagagacttgtgaccctggactcgaacctcttctgcccaagcactcgcctgctggcaactctggctggagggcttggcccagcttctggccccacagccccctgaggtccatgcagccctgtgccagccaggcctacttgagcacgagcatggcctctgtgccatccttggcggtcaagtagaggccatgtgtgaggtagtactcccgccgcaggaaggcatagaagtaatcagagatgagcaggatctggggggagagagagggtgtgaggcgctgctgggtacctccccctaaacccaggatccctgaactgctggcaggtgttgttggaagacaggaacgcccctgcctggctctggatcacaatcactggagaggccctcctcagggcccccacctcagggcccataattgaccctgcaaggtctggcctctcagaagctgcctggactccccctgcccccacccatggtctacacctccatcccaggctctggcctcgaatgccagcctggtgcctgtgcaaccagaggcctctgccccatcctcccacagccacttccatcccagccaggtccacatcaaactcctcaccttccctctgtcaaatacacttctcccactcagcatccatgcccccatcttccagccaggtgcccaggccacaaaattgccctgacacttctctcatacatcgagccaccatgacctgtcaattccccctaaactcaaatccaccctttggatccatccccacagtcactactctggacagagccactgtcatctcatctcctaaacaacagcaaagcttggtccttgggctccctgctctcaaacccgtgcccaccccattctccctggcagccagagggagcttttcaaaacccacatctgatggtgttacttccagccttcaaatcctccaaaggcttcccaagccttagggcaaagctcgaactccctcgtgctctgagaccttgctagggtccctgtccgccctctcccggctccacctcaccccacggcaggatctttactgtttcttctgcctggaatgttctctccccgttcatctagttgacagctgcttactcttcagggctcaggaaggatcacttgccccccagattagttcttggccccactaatctctactcgataacagactcatcgaaagtgtaattttccattcagctgacagcctgactgtgcctcctcccctggcccggggcctccatcagggcagggtcttcgaatggttctgtcactatggtatttctgtgcccagctcagtctgtctgtcccattctgggccacacacagaagaatcaaagggagcctagaagctcagcccactgtctcttcaaggaggcccagaaaggaatagggatttgccaagggccctatacaccagacccggagtctgcaatcccagtcagcccaagcttcccaagaccactggtccctggagcaggttgggcagggcccagcctcagagaaggatgaggggacaggggctcacactacagacaccgcagctctcaggcacctggaggcctcagaggattggcaccaaccacctggcacagatggggagactgaggcacagagcacttggctatggtcttggggcaagacaggttgagctaagcctgggatctagacctccagaccctgtcctgggcagcttctcactgacctgaaggtaacacaacagcagctaaggagagatcagaggcgcctggaggagttcaggaaggtgtcctgtcaccagcagctctgatggcctcaggacaagtacctgccattctatcaccacagaagcccatctggaaggttgaacaatcctcatcttaaacagatggggaaactgagactcaaagggttcaatggttggcctaaggctacacctggagcactggactaatggccatggacccagaaaggtggtctgcctggggcccagatcactgatgagcacgagattggtcacagcgtcagcaaagcagacagagctcaggcagcccccgaggccctgcccccagctgcccagctggcagctccaggctggcccactggggggcagtgatcacagcaaaggctgacctcataccctgcagccctttctcacccaggcccgagatgccatctgggcaggaggagcccaaagcaggggctgagctcagaggctgatccctgaaccaggtcagctgaggggcaggtgcagtcacaatccacaacaatcaaaacgaagcaactccatgtcacacaataatcatctggacaagaagcaggaagaaaaagattaggttattaggttggaccatatgaaattgccagttttgcagataaaaaaatggttgaatactggcaatttcatatgatccaacctaatataaaacggaaaaacgtacacatggaaaagtaagcatgttatttagaagtaccaacagaaataacagtaagactttaggtagctattcttttcccctataagccttaactttgcaaactacatacatgtattccattgataaaaataaaacttcggcgaggtgcggtggctcatgcctgtaatcccagcactttgggaggccgaagcaggcggatcacctgaggttgggagttcgagaccagcctgaccaacatggagaaaccccgtctctactaaaaatacaaaattagccgggcatggtggcgcatgcctgtaatcccagctacttgggaggctgaaggcaggagaatggtttgaacctgggaggcggagatgcgccattgcactccagcctaggcaacaagagcgaaactgcgtctcaaaaagtaataataaaaaataaagcttcaattaaaacaaatcagccaataaatcaatgaatcaatacatcaatggggggggggagataaatcttccttccagaagaattccaaacaatgtaggtagttatatccccctcccatagaaggagcttaattcttgtccactctgcatctcctaagcctaggggggtctagacttggttactcacttcctcctgaggagcagggaaagggaaaagagtaactttacagtggagagacctggccaacactatcttaaccacgtggtggaggttaacatcagcttgaaatcacgtggctagcatgtaaccccaatagatgtgatgagaagggcactttgcctggggtattctttctaaaaacccacaaccccaggatagtcctaagaaaagcatcagacaaacctaaactgggggacaaacctaaattgggtgacattctacaagatacctggccagcgctcctcaactgtcaaggtcatgagaagtcagaaaagactaagaagaaaagcagaagacactggggagatgtgaccttacatgtaatgtggacctctcgatggggtcctggtagagaaagaggctgtgactggaacaacaggaaatccaaatccattctagtgtttcagactaatagtaacgtatcagggtgagtgtcttagttttgacaaacacatcacggtaaaatataagatgttaacaacttaggcaactaggtgggggcttacaggaactctgttctatctctgcaacttttctataaatctaaagtgattctaaaataaaaagtttatttaaaaaataaatgaactagctgggaatggtggcttgtgcctgtaattccagctactcgggaagccgaggcaaggggatcccttaagcccaggaggtcgacctgggcaacagagcaaaactccagctcttgaaacaggaaaaaaattaacagcaatgacctattgttgtatgtaacaaactcaaaatattttgctgagtgaaagagagctttggcaaatgtacacaaaagatttgcacttttccctgtataataaattttacataagaaaatgatacacatgctgaaatatttagcaggaaatgtactgatgtctgcatttcaatttgaaatacactaaaaaagtaagatggactgagggatgatggaagaagtacctgaagatgtgaatggtggactcccgctggtgggtatgtatatgggtgtccaatgctaaagctgtcaactctgctgtgtgtgtggaaatctggaggataaagggggtggcgggaagagccctgtgagcggcttgggcacacagccctgggtgtcatcagtcctgagtgagcaccctgcccccagggagaggacaccaggctggccgagaggcctggccctttcagagggaagcctgtagccaggacaacctcttctgaccttggggctttccatttgggccgtgaggagagcagggatttcccagaggccctagggtgcagccaacacagcagctgcagacccagagcccctttgcccagtctggacaggggcgagttgggcaaggggctgtggaatttgcatgggcgagtcagcggctgtgtgatattaagtctcttcctgtcccctgggctgcattttcctcatctggaaaatgacagtaataggctctagcttgttaccaacaatgctgggctcctctagtttttttttgagacgaagtctcgctctgtcacccaggctggagtgcaatggtgtgatctcagctcactgcaacctccgcggttcaagtgattctcccgcctcagcctcccgagaaagctgggactacaagcgtgcgccaccacccctggctagttttttctttttttgtatttttagtagagacggggtttcaccatgatagccaggatggtctcgatctccagacctcatgatccgcccacctcagcctcccagtgctggtattacaggcatgagccaccgcgcccggccgggctcctctagtctttgtgccagttaggaccccagaacatgtcactctgtgtcctcaggtctctggatcccacccaatgtggctgaaatactgccttgccaatccccttctcagacttgccctcttctcttcctgcagccacctctctggacacacacacacacacacacacacacaggtgcacacacacgcacactcacactgctcacacatgcacacacaggtgcacacacatacatgcacgcttgcactgctcacacaggctcgcactgcactcacacacaggtgcacacacacaggtgcacacatacacgcatgcttgcaatgcttagacacacatgcttgcacacacacatgctcgcactgctcagacacgctcacattgcactcacaggtacacatacacgcacacaggtgcacacatacatgcaagcttgcaatgcttagacacacatgctcacacacacagatgcacacacatacacgcacgctctcactgctcacatgctcgcactgcactcacacacacacagatacacacacatacacgcacgcttgcctgctcagaagttccctggctccccctgccctgcccagcagcgctgcagctcccacctatccctcagaggctcatctcctgccaggagtcttctctaaccctgcattgttacatggaccctgaagtgaagtcactgcccactggcctcccaaccaaatggggctgcatttgctccagttctatggccccaggcccggcacagggccagctctctctgagttgtttgctggtctgtaccctctcagcgctgcccccagggacggctcggtccacattcctctctatggcagccatgagggctccagggccgcctccctctgggaccatgatgaagagctcatggggcagctagctgataaaggggtgaccagggacagacaggatgaatcagaagtagaacgaaaccctcagaacatgctctagtgcagggcaggatggagagacagggaaatgaatatcttctgagtgtctgccctggtccaggccctttaacaaaaaaacaatattgtccctttccaaccccccagggtagggctgacaatgcctacttagagaagggaagctcaggggttatgggccctgcaaaaggtcacatggtaggaagtgaagagttaggggccagtcctgcctgtcagaggcccaatcctgagttcttccacaaccccctagggtctgcacccacatgaactgagtcctgctacatgccaggcctgtgctgacacctcaggtacctttacaccctgcggagtctgctctccccagttcacagctctgtcactcagtggagagagagagagattgactttttttgtaaaaagccagtagaggttgttaatacagtgtgtcttgaaactactgggctcaggacagcagccttgtccaccaccagggctgcagattcctagagaagcaggtgctatcacccaggcatgtcctggttccccaggcctcctgctgctgttggggacacagacactgacatttgacagtcagcccacgctggggggaatgcatgtggccgtcacagttggcaaagtgcagcagcctctgcccacctgcctgggatccaggaagctgggaggcagaggaggctggcggccgactgtggagctggacagcactttggcgtaacctggcaacccacaggccggagcggacattatgtaggaggaaatggtggaggagaaaactccaccctccagctctgaagatgcaaagtaacaagtgaaatctctggacctcagtgtcagggtctgagaggtcacaaggtgagactgaggatgaggctacaagtaactgtcccttacatggcacttttcacttacatggcacttttcccacattcagtcctcaaaaccaccttcccagtttgaggaaactgaggccaccaccacctcccccagatttcaacctcccctagcctcgtccctggtgccctggatgccaggctcacacctcttacctctgctcttcccagcagtgaggttttcagagcatggatctgatcacatttatcctcagctcttaaagccaaaggtgcagtctggacctctgcataagaggcccttgaaggcctgtggtctgaccactgctgtctgaattgccctcattccctctcaagtggtacagccagtcccactgagctcccagcagcacggtgttcctcctttgctccctccttcctcctctctctctctctctctctctctctccctccttcacccccacccaggtcttgctacctaaaatcatagaacccagttagatcctacccatccctcaggaccccacttagaggccaccttccccaggaagcctccttaacagcccagctctgggctcccagctcgtcaggctgccctgtcctgcccatgtcttttcctttctctccacagaccgagggctccttggaagtacacctctgtctcattcacccctcgcagagtgcctggtgaatagtaggaacctaattaacatttgcaaataaataaattagcttcccaggagttacgggatgtgcctgaggccagcgagccaggacagacagggctggagtcgctatagagtttgggcttccagagccctggccttctgtggcctttgtcctgctgtatgtagcctgggctcttcctgtcactctggttgttggggaggagaataggctgggaagggcctgtgagggacaagcttgggatgctcagtgctggaaggacaaaggaatgaactaagaccttgacagaattacactagttgggaaaagcaaagtaaacacgcacatccagcaggatgaggacaagggctccaggttggccacaggcaccgcatatcgggagcaacgagccttcccacacacagacctgggatcttgcacagcccaggccacacacaaccggcaggaagaaacctgaaatgggtctcgagccaaccccaaatgggggctacacaccactcagccactaatgacccacccaacacgtctccaagcatttcctcataggtcccatttcccagaatgacacaccaggccaactgagaggcaactccgggagacaggattgtggtttcacctgtgttgcagtgaacagtgagtcccaggcaggggacaggcagcatgcaggaggttggtgtcagacctcgggcttcaggcctcactcaaaacagaaaggagaatggccaatgcaaggccagcccagtatctgagggtctgcagtacagggaggggtcagggctggcccctcatggcaaataggcagtggcttgaggagtagggttccagatgatccagatcctgcttggaagggtgggtggttggccaggtgcggcagctgacacctgtaatcccagcactttgggaggctgaggcaggagtttggcttgagctcaggagttcgagctcgtaacaacatagcaagaccctgtctctaccaaaaatttaaaaagtagccaggtgtgggggtgtgcctgtagttctagctacttgggaggctgaggtgggaggacctcttgagcctaagaggttgaggctgcagtgagctgtgactgtgccactgcaccccagcctgggcaacagagcaagaccctgtctcaaaaagaaaaaaaaatgaaataaaattaaaaaaaatttttttgagatagcattttcactcctgtcacccaggatggagtgtagtggcgtgatctcggctcactgcaaccttcgcctaccgggcttaagcgattctcctgcctcagcctcctgagtagctgggattacaggtagcttgccactgcacccggttagttttgtatttttttgtagagatggggttttgccatgttgcccaggctgttctcgaactcctaagctcaagcgatctgcccgcctcagcctcccaaagtgttgggattacaggcacgagctactgcaaccggcctactaaaataaaatttaaaaaaggaagggcaggcagacgagaagtctgctttagatgtagacacagggcaggagtggggctctcaggccagctactgggatacaagggtaagggggctctggctctgaccccctagtaatccagtagactagccagaggcccaaatcagaccaaaacagggattggcacggggaggtcagggtgtacagaaatgtgttagagcattggtcataaaatgtggtttctgatgccagctcattcaatttgtcatcaataagtagtcactgaatattcttcttggtgctggggatacagccatgaagaagacagacccagggctcgccctaatggaacccacagtctactaagaggatgtgacaaacaagactgtggataaatacaccccttcacagcttagtgagtttgggtaagtctctaacccttccaagcctcagtttcctcatttgtatcatgagttaataatagtacttccttcaaagggctgttatgaggagtaaattccttataactaaagaaaaaaaggaaaacaatgtaaagggctgtcagtagagtagttacataaagtgtggtgagttcacatatgcaggactcaaataaaaaggaggttcctctctcacatatgagcaaggaaagttcacccagacattttactaaaagggaaaaaagtcctactttcatcattatgtcaataataaaacacacatacccacatacaaataagcctctctctccatgagcctatgagtttatgtaaatgcacacagaatggttcggaaggccatctgagcacgtgatcagaagattatagggatcacgtggggccagcccctagtaagctctcctgaaacatgagccactgttatttatttttatttttttttgagacacagtctcgctctgtcgcccaggctggagtgcagtggcacgatcttggctcactgcagcctccaccttcagggttcgagcaattcttctacctcagcctcccgaatagctgggactacaggcgcgtgccaccacatccagataatttttgtatttttagtagagacggggtttcaccgtgttagccaggatggtcttgatctcctgacctcatgatcccaaagtgctggaattacaggtgtgagccaccgcgcccggccgcataagccactattaattttaattttaggagaagattttcttatgttctctgtttttaaacagaatgaaggtgagtgtgacactttgccctactcttttaaaaaagctaaatttaaacaagttcctttttgtttatatgtaatccttgattaatattttccacctgctggtcactgactcacaaaataaaagggttaaaaaaaaactgcttcctttggttcatggactgtctctccaggaatctgctctgggtatttgaagagcatgttgctcttgctgtttcccatgtcaacacacatgagtaatggcaacaggacccacaagttatgtccaatcctctcaacaccctggaagctgtgggtcatcatcccggtttttgagataaggaaactgcaacctagagaagttaaatcacttgaggaagtgggggaggccctcaagaaatccactggtctcaatccctccttcgttctctcacactcaggcgcaccccccaccatggatggtttactgttgtcatttcctgttactgactctgaggaacaaccataattagcaaatgaaccatgccacaggcagaaaaataatagctcccagggtaaaggatggggccttagtcactggtttacctgccggtataactaataatccacacataatttgttctgtaatagggtatggcactgaacaactcaaacagagcaggatttaaaaaaaaatctataagccaagatgttctctatattcagctcttgatttcagcaatgatatcaaggttctagatacttccttgaaatctgtactcatctggttcctaagagagctctgctttgtcttgcccaaggaggagaaaatgaggcaggtgaataccaggcaccttcctagctcacagcaggatatggaactgagaacatgtccccaaatcccgtacgtctcgatggaagacacagaagcaggggctgggtttgggctgcgcaggacatgcaaggctgagaaaaagacagtgggacaaggggacctcatgaaaggtctctatgaggaggtgacacttcactcttagtaaaacttgaaatgtctcattttgcactctgaggctcccaacaggtccaaaggcaagggtggcataactttcatgaagaggggctctcttacctcagtcagcgctctgggacaaggacatgcctcgagtgactgcctcagtgagcaagtggccccatctgatgcaccctgttagtgacctggcagcagcagcaacaaagtcgaaagccagcagccccaggaagtacttggaccccctgctgggaggcctgtaggttggtgtggcctgcctgaagggcagcttggaaatacctgccaaaggcgtaaaatgcatatgccccctgacccagcaaatcccaccacgtggaatctactctataaaactccagcatgtgtgtacaagaatatgtggagggatatgcaaggctcttccattttatttatttactatttattattacttttttatttactaattattatttttattatttattgctattgaccagcctggtctcaaactcctgacctcaagtgatcctcccatctcagcctcccaaagtgctgggattacaggcatgagccaccaggcccggctgcaaggctcttacatttaaagtgacaaaataggctgggcgcagtggctcacacctgtaatcgcagcactttgggaggtcgaggcgggcaaatcacttgaggtcaggagttcaagaccagcctagctaatgtggtgaaaccctgtctctactctctaccaaaaatacaaaaattaggcgggcatggtagtgcacgcctataatcctggctactcaggaggctgaggtgagagaattgcttgaacccaggaggtggaggttgcagtgagccaagatcacgccattgcgctctatcctgggtgacagagtgagactctatctcaaaaaataaatatataaataaagtgccaaaataaccaagggcaacctcaatgcccatcagcagggctgtacctagtccaaaccactggatgttacagaggtattaaaaaattatctcaagacaaaatcattaagtgaaaaacagcaagccaaagaatgctacttaaaggagaatgccatttacctacataaacaaacaaacaaaaaaccctctttatgtacctgtgtctatagctgtctataaatgcacagaagaaagtctgcaaagacacataccaaactgatcccaaaggccacgtctgcagaggagtagaaaatgatgggggctcaggcagatcttttcttttcattgcatagtctttttattttttattttttggtagagatgggcttttgctatgttgcccaggctgttcttgaactcctagcctcaagtaatccttctaccttggtctctcaaagagctgggatcacatgcatgagccaccacactcagcccattccatattcttctattttgtttgacttctttcccccagcaataatgaattcatgtattacttgatgatttaaaatacattttaaaaagagattaagaaaaaaaaaggtaagagatcatgccaagagtccagctggtttctctcagctatgaacacacttgatccacctgcctttggtttccatccctaaccccaatccctctttccaataattcagtttctcctgccttcaatggcacctgaccacttgcagacaaccccctgtgctgctttagagtcccttctctcagaaaggcagccacagagaagaaagctgttatctggcaagttccatggatgcttcataatcactgcaactgtatttccagacccaaacttaagactaagactcatgacaagacaacaggctgtggactatttctgtggagcttgccaacctccctagaggcccagggcaggcccaatgcccacccatgccagctaccactggaaggtaaggaaaaggaaggagatcccagaaaggcaggagagccagggcaaccttctggattccttcaggatatgcaattgagccctgcagaattctgcctgcgtgggtcagaagtaagagaggctgcgcatccaccaaccctaactacagtgtgagagacagaacaggccctccggctgggccccacccaggctacaaggccctctatctctctttcttctgctcacaaaccaagacaactggctgggctgaacattaatcctccagaaatgtccatgcaggaaacaccagtcccatcactcactgaaaaagccctaactcctttcttttcccgcagctaaccttggaggcaagaattaccctggggattattcactggcatcattagtctttccagccagcctgcttcccatccaggctattacacataggaaatgcctggctgtgccaatggcaattgaaatggtaaatggtacaagtgattctcaaaagacttccactacgaggccagagcctgacctgagagaaggcagcacgtggaggagggaacttccaagaagcgtgggtgagtccacctagagtttgctagacccactgccacagaacctctggaagagcttattaaaaatataaattcctgaccctgtattccacattgaatcaacatttctgggagtgggatcagagaacctggctttttaaaacagagccatgtacttgggacggctgcaacataattgcagagtttaaagcctgttaacagggaatctgcatttttaacaagctccctctgaggattttgattgagaatcctgctctgtggaacagagggacaggcttcccagctcaggggaaggctgagctccttgctggtactcctcagcctgtgaccacagcctcctctccaccgctcccagccacacaatttatgctcaactccccaacagccagaccggcccccttctcctctgcctgcctttgttcctgctgtcccgagagtccgcagagcctctcctccccttgccttgccctctccccctcactctatctactccctatgggtgctggaaccacaggcaccattacagaaaggggtgcctcagaaatcaagccttatgtgaattttgttcttggctcctccaatgaccttcgagaagagaggacctctgcaagcctctgtccctcatttgtaaagtagggctaacatgccctgtctcctaggcttgctgagaatacagcatggctatggttcagtgtggtgcccaatacatatctgccaggttcagccttacactgctcttacttccccgtcctcactgactgggagctacttgaggggagtaactgtgcctccttcacgtctgcaccccccggtatgcagaatccaaggccatcgttgaatgcttgaggctgcaaaatgaattcctgtccccaagctgacccccatgctgtccctcttacctgcccaacgttgaaggtcagtgtgatggcataaaagaaattagagttggcacttcctgcataaatccagaggtgccacaggacagggaagagcagggaacagacgatgatgatgcaggtgaggacaaagatgtttctcaggactgcaaagacagagggttacagttagcctgacacgctctctctggcatgctttccctgctgcaatggcccccctgaatggagaggcccaaggtgagcatcatgtagctcaaaggcagagcacccccagaggtactggggtgccaagaagcaaaccccagactcctcagtcaatggctccccatgcccacagctggtggtagctcctggatttcgattatttcctcccactgtgggcttggctggctgaagaccagctatagttagaaatgccatgagtgcctcggggcaccaaacagggcatttcaggaagatattcccctcacctcctaatcttggagggtccaagagtatccctctccccaagcagggtgccatctggccatgtgggattatgggtgggaaccccagcatgaaccgtgacgattagagccccactgtgggtctccatggtgccacagtcctgggtcttaggaacacgttttccattctccttaactggtgtcttaggacccctgcctcgctcttcaaacattcccaactctcccttagatgataaaggacctctttttgacaccgtctctcactccttgcctctaagggaatgccgaatcccaccaggaagaaagctctccctgaggtctcaggaaggacctgctactcaagggtgatccagaggcagacaggctggctggcttcagccaaacaggagtgtagcatggcagccgggtacagaccttggttaaaatcctgctctgcatttattagcaagtttctctagacctcagcttcctcatctgtaaactgaggctacacacctagtatgtacttataaaaattaaaaattagggtgggcatggtggatcatgcctgtaatcccagcactttgggaggctgaggtaggaagattgcttgagcccaggagttcaagaccagcctgggcaacatagtgagagcccatctctaaaaaaattttaaaatttaaaaataaaaaatgtttaaaaataaaaataaaatggggctaaaatgcacacttcatttggtaaacaagatgacatgtgaaaaaatgacacagatatatcactggctacattagttttccattgctactatagcaaattcccacaaacttagtgatttaaataatattctttattattaaacagttctggaggtcagaagttccaaaatgggtctcacaggctaaaatctctagaggagaaccccttgcttgccttttccagcacccagaggccccctgcattccttggttcatgacccccttccagctgcaaatccagcaatggtggattgaggccttctcacattgcatcactcagaccttctcttctgcctccctcttccatcttttttttaaaatagactatttattttgagatggaatctcactacattgcccaagctggagtggagtggctggatcatatctcactgaagcctcgaattcctgggctccagggatcctcctgtctcagcctcctgagtagctggaactacaggcatgcacaaagaagcccagtggactttattttttagggaagttttagtttcacagcaaaattgggcagaagatttcccatattccccccacctccacctcttccactttgagggacacttgtgattacactggggccacctggattgtccaggataatctcccctcccaaggtcttaaagtccctttgccatgtaaggcgatgtcttcacaggttctggggattacaacgtggacatctttgtgaggggagggctactaccctgcctaccacactgtactttttcccccgttttaactctctaggggttatcacacaggaggattgtctgttacttttctttatctttatcatatttttaaaaactaataaatatcatttaaaataattaaaagaatacctttttaaaaagaacttagcactgtgcctggttcccagcagacacttaatgaatggaagttcccttctcttctctgatactgaccttcaggaaatcccttctcccaagtgacagttttgagagacttaaagggtggagaaactcccaaacatttaggccatttatattagttgtacaacttagtagagatgctatactgggggctcatgcattgcaaggggcctagatgatacagatgattctcaactcccgctacaaaacaaaatcacggccgggtatggtggctcacgcctgtaatcccagcactttgggaggctgaggcaggtagatcacctgaggtcaagagttcgaaaccagcctggccaacgtggcaaaaacccgtctctactaaaaatacaaaaattagccaggcatggtggcgggtgcctataatcccagctactcaggaggctgaggcacgagaattgctggaagtggagaggcagaggttgcagtgagccgagattgcaccactgcactccagcctgagcaacagagcaagactctgtctcaaaacaaacaaacaaacaaacaaacaaaacaaaatgaaatcacacggagagccctcagactagtcaaagtctctagggtggggttcaggcatccatatgaggttttaaaagcttcccaggtaattccaatatgcagtcgaggctgcgaaccactggattacagctgcagccccttacagtctgcaacagagatgccacccaactgtgtcaaaaggagaataatcaggacacggtagttcacagttctttgtaaagctgaatgttttcaagttacagttcattctttattgagaaatgataggtatcattttgttgttgtcattaaaaagtccttcattttataacatggggaagaatggctggtagttgattgttttaatgtcttcagcaaaataaaaagctggcaatctgtcacccgagtttattgaaacattagtggtctaagaaatcccacaatttggacactggcctggagggcttgcaagatcctcttttctaatctgaagtttctcaattctgggttttcaaagatgagaggccaaaaccctgactcaagcctcctgagacctcccaggaacaaggagtcttgcaaagggacgttttcactgagaattactattattattaaaccatgttactacctcaagaaggagaacaaatgcttcccactcctctaacccaacatcactatgtacatttctcagtggttctttctgatcccctggaaattattttgctgaaaagaatacagactattcccaaaataaaatgtttgcagcctgccagaccaggtggttcttgttctgtgcctccagccagggacacagatttcagacagggtgacaggaaggaaaccaagtgcaaagagacgagagaagctcactggcagcctctgggtgctatctcgaagggctgcaaagatacattcccatgcggctagagaaccatcaccagcatgcagttggcttctggcctgtggtgacctctgcaggaatggggagctgctattcactcttgctggctgacaggccagaagattaaagctatatatgccagagcagatggagctggagacctggggtacgggacagcttgttccaggcatcagaaagcgtcagaggtgaccagggcctaacaaggtgaaaggcttcacccttcatcagacttgcgaggccagatggaatcaggttccccaccacattcactgggtggcttatccaatctctggcaccatgattgatgaactggaacttcaggcaagccactttcccttcagagcctcaggcattcggaaagaaaatctcacctgaaaaatccagtccaatcagaaggggaacaggggggatttggggacttcaaaggccatggtgatattccctttcttaaacgaggtgccaaaacacgtgggaatatattttatcatgattctttatatgtatatctatcaacattcttttatcgctatacaatagtaataaaaacaaaacaaacacacacacaaatccagccctttggtaactggctccttctgctgtaccatgcaggctggcatgggttctgccagcaggctgttccctaacaccacaattgtgcgtctgtatgactcatccaagctccagagagtccagcgtctgggacctacactcagggaggggccacgttccttttctcctctccactgcacaggaaaacagaaaggtgaatgtgggagcatgcatgttagcgctgacagctaatgtttaaatggaattcctagccacattaaatatattcaacgtaggcttaaacacgtctcaacacatacatcccactcataggtcctaaggaccagggctgatgctgctcccagctaataatgattcacagttgtcaagccccaagcaggttctccaagcacgtgtactccctgctgcaggagcagtgaagcaaaggtggacagctactgttctctgcaggatcttcagacaacctgaacctgcagactatgtgccctgccagccagcaaaagcaactattagatcattcaggtttctggaaaccccatccttcttctttgtgcctcctcaccccagagggcataaaatagtttattcgtcttgaaaaatatgtttattctgatgactctggctaccaagcccgaagctctgatcacggaactatgtgagagactcccctgcataattattactcacgatactaactgcagtgctatttacagatattctttctcaaacttaacacactcatgagttattttctttatttgattaatggaaaaatcagatgctcagaaaggttaaatgatgtgcctaagaacacatggggctcgtaatggcaatgccaggaatcggagtcaagtgactctccagactgctcagcaaatgggatgaaagacagtcactgagagagaaagagtgcccagtgtgggatgggcaaccacaaaaatccattctacattcttgaaatccactatcacaaactgaggcatgtccatgttttggtggtctcatggtttgtcactggccactctgccgaggggccccaagctgactctcaacctgctggactgggtgactcttgtctgtgcagagaggatgtcaccacagaagacactgcttcctcctcccagtcaggccagatgggtcacagccccactaggccatcacctgcaggcgtagccctggctcagctgcccacaccactgtttaccttcactcagaggcacactcctataggtaggctgcttcccacagctagtcagtttcacttcctggttgacacccaaaacaacaacaaagattcacttcctctgaagcctgcactccctagttcattcttgacaccttgctggacacccacagcaggcaaggaaagttcaacagctcccttccatgcctcgtttagagaatcaggtggtgctgggccactgacactgcctctttattggggaggtttaaaaacccgctccacaaatgtttgcaaggtcttctatgtgtcagcttcagtcctgagtgctggggacacaaaggtgaatgagttgtgatatctaccctgacggagcccccaaacaatgaaaagaacccaccatagagggctaagagcactgggggcctaggcagcacagataggtcaccactaagccacctctgaagaggggatggttagagcttagaggggttgtcacagtgggcagggaagtctaactttgcccctctgccttctagtaacctttgggtgcagcgctggggaatggttcaaagcccagggcatagagttctgctgtctagtatggtagcctagctacatgtggcttctgaaatttaaattaaaaattcaggttctcaggcacacaagtggctagttaccctattgaactgtgcagacagaggactttttcatcatcataaagccctgctggacagcactgggtaggggttcacagatctggattccaatcccggctcttctaattagaagtcacgtgactttgaatgagtggctctacctttctgtacctcagttttctcatctgcaaaacgtggatacttacctcaaaggctggtgtgaagatcaaatgagctaattaatgcatgtaacactgtgagagccacagtggccaggtacacagtaagtgctcaataaatggcaattatttttatcatcacaagtccgcggcacctggaagcagatattgtgcttcatgcctctgctcccctcctagtgctgccagcataacaggtgcctggtaaatgcctatgaattccttttccctgcagcagtctcatccaggcccaggctgacacaaatctgtggcagaggcgggagtactcacatctgtagagatggttccacacggggaagaaggccatgtagagcgccacgtcccccactgtcgggtaggacttaaagatggcgatgacagcgatctggataaacatgaagaagatggggtgctccctggggcagggcaggggaaagagagagagagatgagtcagggaccaggcctaccctagagactcctgactccatcctttgaaccaaaaataatcctcaggggacttcaggaaggggctggctctgctatccacaaggcatgggccaggccccagtagcagagcagaaaactgcagggacccagaaatacccagaggtggtgaggagggcctggcaaacactagggaaacagcccacagagacatttcccatcaacagtccccctctgcctctgccagctctgggccttcccctaggagccacagaggaagaaaacaaatgaagtcagcattctttatgactgggcttaaatgactgcttggcaggataattaggcagcctcccttgccagaggcccctctgacaattggacgcaaggcaggaagtgcctccttgctgatgccttttttctctaacaacatggtcagcagggtctacagacccatagtgcgatgaacttctttccaggaagagaactgtgaactgcacagagcttttcagttcttaagggctgggactattcttgttaacttaaactaatagcagtttcaattattattttaacctaataataagtgatagcaatgggtatcctctcctgaactccctctgtgtaaagtccttttcctgcatcctctcacgtgatcctcaccacatctcaaccacccctcaaggcaggcaatcctgggccaggcgcagtggctcacatctgtaatcctagcacttcgggaggctgaggcaggaggatggcttgagcccaggagtttgagaccagcctaggcaacatagtgaaatctcatctctacaaaaaatttaaaaattagccgggtgtggtggcatatggctgtaatctcagctattcaggaggctgaggtgggagggttgctggtgccaggaggttgaggctgcagtgagccatgatcaaccactgcactccagcctggatgacacagtgtgagaccttgtctcaaaaagaaaaaaaaaaagtaggcaatcctctcacctgtacttcacagatgaggaaacagattcagagaagtgcactgactgagtaggttagtaagcgatggagttgtctccagagctcttaatcacgcccaataccattctcctgagtgctgatcacacttccaagctctggtcaggagagagttgggggacagagctcaatctcggtgcccctccgagagctgaccaagtgctaaagggaagccaacagggagaggctggatctataccctcctcagctacatttcaaccacatgcacatggcctacttctgcacagtacctagatgcctagcccatgaaggttttcttcagagattaatgacctttttgtcttgcaggtcaaaggtcagggtgactcaatgggtatgaatctgagatgtgcagacaaacatgtccacacccagaatgctccagtgctgctgtgcagcaagtgcctcagaaacgcagcttggcaaaggcgtgcagccctgtagcctctaagaagcgtccagctatagctcagtgtgaacatcttcctaaacacaatccacatcactggcttcaggcttttcaggtagctggtaacaacggcaacatttctatgaaaaggctggtgaaaatgcggtgacaaaaaaacagactacagcctcctgcagcactgcacagggactggggtggcctgaagggccctgttcctacaaagctggcactggaaacaaatcttgcagggggcaggagagcttaggtagagcttcatacccaggcagaagagaagacagcagggagagcaggtctcttcatattttctgtccccacaactgtgtgggcctggcttaggtcataaaatggtgacattattgcctagccaggagcaatgtgtggctttgcatgcagacaataaaagctgccggagagctggctgcacggccagtgcggaaaggtgccctgggatccctgctcctcttcaccccatggctgggcctaaccggaacaaggacagggaaggtggaccacagacagctggagagctcagctgggcaaggctgccagagttccggagcctgccaggccatggaaggagggtgttctgtcagaagccaggccaaggctgtgtcatgggaaggaagcatcagcttttgagattttacagaatgggaaccacgtgcattggtgcacagaccatggagaatggcaggaaggttaggacagagaacttgagctcttgaaacctaaatcaaactctttcaggttccccagaccatctaggcgtatctgtacctgtctgtgtctgttttcccttatctgaagctaggataatagaaccatttccggaggctactaaaagcaatctctccggagcttggcatggtgcagggggataagcatagattctggagccagacaaacctgagtctaaatcccagctccactgcttactagctgtgtgactgggaaaatcatcccacctctctgagcatcgatttcctcaactataaaatgggagtgataagaatctaacgcctacctccaggagttgctaggttaggtatgattatgtttcagagggtctagaaaggcacctggaatggagcaggcctaacatctatcagctctcttagactgcagaagaggactccacacatcctttggagggaaacagatcaggagattaaacagttgcaggtggccagcctcccaactaaaccatccagagtccctgtggaggacctgtcactgggctgttgatggagacattccaccagatacactttttccaaacacactcccctccacaactcctgttcttttttttttttttttttttttttgagacatgcacttccgcctgtcatccaggcagaagtgcagtggcacaagcagctcgctgaagcctcaaactcccgggctcaagtcatcctcctgcctcagcctcccaagcagctgggactacaggggcacaccaccacacctggctaatttttgttgttgttgttgttgtttttgttgagatggagtcttgctctgtcgcccaggctggagtgcagtggcacaatgttggctcactgtgacctctgcctcctgggttcaagcaattctcctgtctgagcttccagagtagctgggactataggcacccgccactatacctggcaaatttttgtatttttagtagagacagggtttcaccatattggtcaggctgatctccaactcctgacctcaggtgatccactcgccttggcctcccaaagtgctgggattatatgcgtgagccactgcacccaggcagccacctggctaatttttaaattttttgtagatacaggatcttgctatgttgtccaggctggtctcaaactcctggcctcaagtgaccctcctgcctcagcctcctgaagtactgggattacaggtgtgagccaccatgcctggccaccgcctggctctagtccaaaacagtgaatgggctcagcagcaatgtggacttgagcacctcagagtgaggccagggaaaatgctggggctccaaagcaccctcactgcagcctgcacccatgcgactctattgcctgctatggcgctggcaactgcggcaactgaaggcaggttccttaggtgagatgctctaaacctgacagcaggtgctccacatttgaaggccaccctcaaggctactagaggcaggggcttctcggacagctctgtacacacagcagcagcaggtccagccacttactttagctttatggctaaggggatggtgtagaagaagacgttgatctgaaacacacatacaaagaagaggctgaagtgctcaaacatctctgcaaagaagtaccagaaaagaccaatgtttggagtgagatctggaacagaaagtctggaattaagaaaacaaagggagagaaaaaagacaaaagttataaattgtctgctttgaccttgatttctcctgaagactttggtcactgctgggcagccaaggacgactttctccctagagagatcaggatgggaagggctctctaggtaccctggatacaggtaattaacaaaaatgagcagagacatataatgataacccataacaaatattagctaagccaaacaaatctgaaatgaggcagggattcatcctaggaataaagagactcacccctgttttactgcgcaagacagtttaaaatcaggagatacccagtactgtaacaaatgagttttaaaacacaggatctattttgggcattctaaagacctgcctagaggaccacgctcaaagatcctgctcctccccattcttactccacaccccacagcaggagtcagaaaaccgagtgcctgagaccgaagtgagacttctaggggctttaggaacaatcggtgggttctggctaagatccccagggtcccagtcttaattgagaaattagggtttaactggaaaactttttgtccaattaaatcagacaaatatttcgctgcaattctggctctcctaaagtttacatttttgatttaaaaaaatatgaagttgaaactgatctcaatacacaattcaaaaaggacaacaaatagggcacgcagagggagagatgagtgatggctcttggtcagatttccctgactgaggcctccgcccaggttaacttttgcctcttgctgtaactatacctccttttctgggaaatgaggtaaagaacacaatccgtggcccaggagaaagaactcttcacctggcaccgcaactcctatctaaggcagagcatgaagagctgaagttagcaagtcattgttatgctcagccaggatttaacacaaataagcagtccagaattccaaatgggagttctgccactcagatcccttccacacatgcacaggtttaagagtctgtcacctattgggctgtgagctccccaaagcttagggagcaaccgagtcttcggcacctatgcagagcctggcacgcagagggcattcggaaatgtttatagaattcatgaatataaactcagacaagcctgcaatactcaagtccatttgagttttccctcaaggtttgacgtgtggcaggtggcattattttcaaactgtcagaggccctcttgcactagaggaacacatccattcctgtttagaattgagcccaaacctcccagttagaggctggtatttgctttggatgttcccagggagtgctctttaacccacttatgctggaggttgcaaatttttttgtgtgaaaaatcagaccttggcgatgaccttgagcagtaggacgtaaataactcccacaagcttcgtgttccaataatagaacactaggcataaatgggttaatcccaccatatcaaaggtgtgtttcagagtacaggttctcaaagtgtgttccctaaaccagcaggccaacagcactggcatcacctggaaaccggagaaatgcaaattgttgatccctccccaagacctacttaatcagaacctctgagggtgggcccagcaatctgggttttaataagtcctgcaggtgattctgatgcaccttaaggtttgagaaccgctgctatttaatataaaggcttcctgtggtccctcaccctctgagtccagctagagctatgaaaaccaaattagcttccagagttttgtcgggggggttttaactgacaacatatagttgtacgaatttatgggtgattttatgtgatgttatgatttctgaatactatgtagaataattaaatctagctagttaacatttccatcacttcaaatattaaacattgtttgtggtgggaacgattgaaatttactctcttagcaattttggtatatacaatactctattattaactatattcaccacactgtgctagtactcaagaaaagaaaagaaaaaaacatattcctcctgagattttgtacccctttgaccattatctccccattctcccaccctgccggcatcggtaaccacccttctactctctgcttctatgagcgtaattgttttagagtccacatataagtgagaacacatgcggtatttgtctttctgtgcctagctcattccacttagcatcagattctccaattccatccctactactgtcataaatgacagaatttccttttttaagactgaatagtattcccctgtgtatatataccaaattttctttatccatttgtttgttgatggacatttagattgattccataacttggctattatgaataatgctgcaatgaacatgggagtgcagacaaatcttcaacaaactgatttcaaaaattttgagtcacctgcaatcccagcactttgggaggccaaggcagatggatcattgagaccagcctggctaacatggtgaaaccctgtctctactaaaaatacaaaaattagccgggcgtggtggtgcatgcctgtagtcccagctactcggggggctgaggcaggggaatcacttgaaaccaggaggtggagggtgcagtgagcggagatggccccactgcactccagactgggcaacagagcgacaccctgtctcaaaaaaaaaagaaaaaaatcctttaagtaagtagccggaagtgggattgctggatcaaatggtaattctatttttagttgtttgaggaatgttcatacagttttccataatggctgtactaatttacattcttgacaacagtatacaagggttcccttttccccacagcttctagaattttctaacgtggtcattacttacataaagccatagactgcggggatgaaatcccaagagctgagaaggaagaaggagaggcaaatgattaccactaggcttcccacatacatcatggcatactcccaagaaaagatccagaaggctttgctcttcattttcacaggtatgtactgccgctggagagaaggcaaagtgatataaacttagggatgtaaacaacagagggcagctattagcttacacttaaagatccctcccgcaaaaccatactatgatacacaggtttataattttgctttggtctttaattaactaagaaggatgtaagtgttaaaaaggtattacgggtgcatcctctgacctcagacctagtaacaccatttctaggtatgtatcctggagacaagttgcagaagatacaaatggaggaagattcattgcaccattgtttggaatatcaagaaaaaatccttcaatagaggaacaaataaattgtggtatattgacatatggtatactatttgccaggttaaatgaatatattgtatctataaatgtcaacatggctagatctaaaaaatatgaggttagttataatagaaaattgctaaacaagcctattatatgaaaatacttatgtgttctgagattataccaaataatactattatttacacacacacacacacacacacacacacacacacacacacacacatctgtaagtttcataaaacatagattagaaggacatatactaaagttatgatagtattagcctcctgggaaccagagaggaaaatataattggaacctaagaaacttcatataacctggcattcatatgcaaaatgaaaagaaataaacaagtaaaaaaagactttaaaaaaacgccaaatttgggttaaaaaaacttcaactttatctgctttcctttgtttgagacagagtcttgctgtgtcgccaaggtagagtgcagtggcacgatctcggctcactgcaacctctgcctccaggttcaagcaattctcctgcctcagcctcccaagtagctgggactgcaggtgcgcaccaccacacccagttaatttttgtatttttagtagagacggggtttcaccatgttggccaggatggtctccatctcttgacctcgtgaatcacccaccttggcctcccaaagtgctgggattataggcgtgagccactgcacctggctttttttttttttttttttttttttgaaacagagtttcgctcgttgccctggctggagtgctacggcgtgatctcggctcactgcaacctccacctcccgggttcaagggattctcctgcctcaccctcctgagtagctgggactacaggtgcctgccaccacgcccagctaatttttatattttcagtagagacagggtttcaccatgttggccaggctggtctcaaactcccgacctcaggtgatctacccgccttggcctcccaaagtattgggattacaggcatgagccactgcgcctggcctcacatattttattaagtatgacaacagcaattatgaaacaatatagcaaaaatcttaatatctgtttagtttgggcagtagacatatggctatcattatacattttctaaatttttcctctcttaaaaatgttttcctcaaaaaaaaaaaaagatgctgggggaagagaaataatttattgttgtaagaaaaaggaaaataagaattaccagaaaacaaaaaaaccaccccagtatgtgagaaaacagaaatgagtttaaacaaatcacaatcaattcaaatgaacaaaactgtataactaaaaatcatgttgtcagggactgggcatggtggctcatacctgtaatcccagcactttgggaggccgaggcgggaacatcacctgaggccaggagttcaaaaccagcctggctaacatagcaaaaccccatctctaatgaaaatacaaaaattagctgggtgtggtggtgtccgcctgtagtcccagctactcaggagactaaggcatgagaatcacttgaacccaggatgcagaggctgtagtgagccgagattgcaccacggctgcactccagcctgggcaacagagcgagactctgtctcaaataaaatagcgtaacgtaacataacataacataacataacataacataacataacataacataacataacataacacaacaacaaaataaaataacataaatcatgttgttaggaaaaaaatcagttatgcagctacatgctatttacaagagatataccttaaaatataagacacagaggccgggcgcggtagctcatgcctgtaatcccagcactttgggaggctgaggcaagcggatcatgaggtcaggagatcgagaccatcctggctaacatggtgaaaccccgtctctactaaaaatacaaaaattagccaggtgtggtggcaggtgcctgtagtcccagctactcaggaggctgaggcaggagaatggcgtgaacccaggaggcagagcttgcagtgagccgagattgcaccactgcactccagcctgggcgacagagcgagactccgtctcgaaaaaaagagaaaaaaaaatatatatatatatgagacacagaaaagctgaaaatcaaaggactttttcagattgccatggaaacattaagcaaaagaaagctagtgtggttatactattatcagataaaatagacttttatgtaaaaaagtattgcagagataaaaatagtccaataatgataaaaggctccattcattggaaaaatataacagttctaaatttgaatgtaactaataacagtctcaaaatatataaaacaaaagtggattaagctacaaaggaaaaatagacaaatccatcatcaatgcataattgatagatcaagcagacaaattagtaatcaaatagaaaaaatgaagcacatttcacaagtttaatctcataagatcttacaaatcatacttatatagagcagggcacctaataactaagtaattcacattcatttcaagcattttgggggtatttacaaaaacatcacatacttaaatcagtccataaacccacattgacttcaaggaatctttatcatacagacttcaatctctgacgataatggaattaatagaaattattaatgaaaagataacgtaaaataaattagaaaaaaacttgctgacctcacatatgtatcacttatttgttgtgagaacacttaacatctattttcttagtaattttcaagtatacaatatattattaactatagtcatgttgcataataaatctcttgaattgtattataaaaaattaaaacacttttccaaataacctaggagtcaaagagaaatgatgtcagaaaatacctcatattactatttgtgtaatgtagataaaacaatactctgagggaaaagtacagccttagaaatttactttggtaggccggcgtgttggctcacgcctgtaatcccagcactctgggaggccgaagcgggtggatcgcgaggtcaggggatcaaaaccatcctggctaacgtggtgaaactctgactcaactaaaaatacaaaaaaattagccgggcgtggtggttgggcgcctgtagtcccagctactcgggaggctgaggcaggagaatggcgtgaacctgggaggtggagcttgcagtgagccgagatcacgccactgcactcgagcctgggtgacacagcaagactccgtctcaaaaaaaaaaaaaagaaatattaaagaaagttactttggaatagaagaaaaattgaaaataaataagctaaacacccattttaagatattagaaaaaacagaataaaccccaaaagaaggaagaaaataataaagaacagaatttgttaaaacagaaaataaaggtacaatataaggaatcaacaaaaccaaatctagttcttagaaatgactcatgttattgatggctttctaataagaataattaagaaaaaaaaaaaaaagagagacgaacaaataaacaacattagaaatgtaaaagagagcataactatagatgtatcagggaggagaaaatattttaaaacttatgccaatgtattttaaaaaaggtgaaatggaaacattctatgaaaaatataaataatttaaatgattaaaaatgcctgtgtaactaaaaagaagtggagatcaaaggacatgacaatgaaatgtaatacatcctgaaccccatcccttcccccaaatcctataaaggtcacatataaattggggagtttgaatttggagagaatatattggataatgttattctatcaaggttaaatttctaggggtgataacagtatcatggttatataaagaatgcctagttcttaagagttacctgctgaattagggttgatgtgtcttgtctgtaacttccaagcaagtaattcaagggaaaaaagaaaaatcaacatatttacatagatatacataatatggcaaaatgataactgaagaatctttaaaaaggtatttataatattatagtactaaatttttctgaaataatgaaataaaaaattagagaaaaaattaattcacaagaaaatagaaaattggcccaggtgtgatggctcatgtctgtaatcccagcactttgggaaccagaggagggtggatcacttgagctcaggagttcaagaccagcctgagcaacatggcgaaaccccatctctacaacaaatacaaaaattagtagggcatggtggcacatgtctgtagtcccagctactccagaggctgaagtgggaggatagcttgaacccaggaagggaagtgaaggttgcagccaatatcgtgccactgcactctagcctgggcaacagagcgagactctgtcttaaagaaaaaaaaaaaaaagccaccaagccactttacgtagataaaaagttcatatggaaaaacaaacatgcaagaatagctaagaaaacactgattaaaaaaatcatgaagggggactagccttatcagacactgaaatataaaacctctataattaaagcagcgcaatattggctcgttaatagagaagtagactagtagaataaaacagaaagtccagcactagaccaaaatacatatggcaatttagtatatgacagtggtggcatatcactatgataaaaattgactttttaatcaatgatgctaggacaacaaggtaaccatttggaaaaggttgaattagacctatctctcacaccattcacaagaataaactccaaatagcttagggatccaaatatattttttaaatgaaatgataaagcactgtactagaaaaaaacatggtgaacttgtctttaactttgatgtagaaaaaagctcaactgtgattgtgccactgcactccagcctgggggactgagcaagagaccctgcctcaaacaaacaaaaaacaccaggcatggtggctcatgcctgttatcccagcactttgggaggctgaggcaggtggatcacttgagtccaggagttcaagaccagcctgggcaacatagagaaaccctatctcaacaaaaaatacaaaaattagccctatgtggtggtgcacacctatagtcccagctatcagggaggctgaagtgagaggatcacttgagcccaggaggttgaggcttcagtgagctgtgatcgtgccactgcactccagcctgggctgcagagtgagaccctgtctcaaaaaatcaatacaaaacaaaactacatacatacttcaataattccactttctagaaatctatcttgaagatatacctccaacaatatgaaaataagtatatacaaggttactcgctgaaacattacttgtaattgcaaaatattgtaagcaatctaaattcccacacactggagagcggctgaataaactatggtatattcacacaatggcgtactacacagccttaaaaaagaatgaggacaatctctattctatctatactgatatggaggaatttccaggaaataatgttaagtgaaaaaaaggaaagcacaaaagagtatctaaagtatgctacccttcatataagaaaggcatataagaggtgggcaaatcacctgaggtcagcagttcgagaccagcctgaccaacatggtgaaaccccatctctactaaaaatacaaaacttaactgggcgtggtggcaggcgcctgtaatcccagctactcgggaggctggggcaggagaatcacttgaacccgagaggtggaggttgcagtgagccaagatcgtgctattgcactccagcttgggtgacaagagccaaactctgtcgctaaataaataaaggcatacaagaaaatatacatataggctgggcgcagtggctcacgcctgtaatcccagcactttgggaggctgaggcaagcggatcacgaggtcaggagatcaagaccatcctggctaacacggtgaaaccccgtctctactaaaaatacaaaaaattagccgggcatggtggggggcgcctgtagtcctagctactcgggaggccgaggcaggagaatggcatgaacccaggaggcggacggagcttgcagtgagccgagatcgcgccactgcactccagcctgggaaacagagcaagactccgtctcaaaaaaaaaaaaaaaaaaaaaaagaaaagaaaatatacatatatacatgtatctattcactggtgtgtgaaaggaatacaggaaagataagccagaaactaaagagaagacagccctccatatccatgggttccacatctatggattcaatcaactaaggataggaaatattccaaaaaaaattgtgtctgtactgaacatgtagagatgtttttctttcattattccctgaacaatacagtataagaactatttacattgtatgaagtattacaagtaatctggagatgacttaaagcataggagaggatatgcctaggttatatgcaaatactatgccattttgtattagggacttgtacatcctgagattttggtacctgcaggaggtcctggaaccaatccaccacaaataccgagggaagactgtaattacctagggtgagaggggagggactagaagaacaggatagcaggaatgatgacagagtaatactgctctttttgtacagctgactcttagaaccacagtaatattttacattcccttcacttaccccctcctcaaataaacaattaaaatcaaccaatatgtggggagaatccaaaatgaatataaaccctaacaaatgaaactaactatattacaaattaaaaacacaaccacactgaagggttacatggcgcaagaaaagaactaatctaagtaattatgaaaaacaggccaggcacagtggctcatgccttaatcccagcactttgggaggccaaggtgggtggatcacttgaagtcaggagttcaataccagcctggccaactaaaaatacaaaaattagctgggcgtggtagtgctcgcctgtaatccaagctacttggcaggctgaggcaagaggactgcttgagcccagtcgggcgatggagcgagaccctgtctcaaaaacaaaacaaaacaaaaaaagttacagtggagaaacctggcagacactaacgtcaccaagtgatcaaggtaaacattagcattgagaagatatggcaatatcatgaacccctcggtacagtgcactgaggacacaatatgcatttttgccaaaaacatgtaaattcagtccagtcatgagaaaactatgacaatctaaactgaggtacatttcacaaaaataacttcacaagtcatgaatgacaagagaagactgaagaactgtctcagactaggacagactaaggagataaaaccaccaaatgcaatgtgggacctaaatatgatcctgaaacaaacaaaaatagcctcagtagaaaatgcaaaattctaataaggtctgtcgtttagttaataatgctgcataaatatcaatttatttgttcttgataactgtatatggttatataaaatgttaacattagcggaagtggagtgagggatacaagaaactctgtactatttttgcaacttttccgtaggtctaaaattaattcaaaataaaaaacttttaaaaatggagataaaaccatctgttacatggttggttaaaaaaataaacaagcaatttaaaaaattagagcgttctacaaggccagtataaaaaaaaatcagccctttgccttgcctctaatcttcattaaatcaagcttgttattgtgatgttcaaatcgtttacatagttattaaatattttggctgtttaatcttactttgagagatttgttaaaactaattacgatggctgatttatcaatttcttctagctgtgtcaattgttattttctaaattttaaagatatcttattagtcaaatacaagtttgaattctcaaaaacaaagcaaaataaacaaaagacaagcagaacttcacgaagatataccactagaattgccaacattaaaaagatcgataccatcaaatgttagtgaagatgtgtggcaactagactgtcatatttggttgggggggttgtaaaatggtgcaaaaactttgaaaaactgtctagtggattctagcaaagctaaacgtacacttgcccaatgtcccaaaaattctgctaggtactgctcaagagaaacaaaaatgttaagtccacaaaaaaacttgtaccagaatgttcatagtagtctatttgtaacagacaaaaactggaaatgggcccaagtttctaccaataggagaatgggtaaacaaaacgctgcacacacaaaaaacacccagcaataaaaaagaatacatgcaataacatggataaatctcaaaaacaagctggttgaaggaagccttatacaaaataatcctattatttcattccatttatatgatgttttagaataggccaaactaatctatggttaaaacaatattcagaacagttgtgtctgaggaaataggagtgggaattgatggggaaaggacccgaagatactttctgtattttgagaggagtttgggttacacaggtatttgtattaagattcatgcacttcatggtatgtaaattctacctaaaatgaaaaagagtgtaaataaataatgaactccagttgatgcttatgctgaattatttacaaggatatgtatgacatctgcaatttacttcaaaatgtatgaaaaataagactgactgatggatagatggatatgtgataaagcaagtatggtaaaatattaatggaggaatgtaggttataggtatatgagtgttcgtatttgttttttctttgaaatttttcattacagaatgttgggaaaatgtaagatttaatacactgtttagcaagccatacatatgtggtaacactttcaagaaaagccaaagaatgattaacaaaaaattcacggtaggccgggcatggtggctcatgcctgtaatcccagcaatatgggaggctgaggtggtggatcacctgagcccaggagctcgagaccagcctgggcaacatgatgaaaccccatcactatatatttttaaaaatatataaataataacaaattcagggtagtcataacctctgaggtagagggaaggagtgcagtgtagaaggaggacgtacagggcttctaaaggactagaaatgttacattacttaagcagggtagtggaacacagtgttgctttattatgttttaaactatgcaaatattataaagcacaagggcattcaagacagatgggacatcatgggtatgggacctgaggtgggatggaacttgccacactggaggaacagagaaggtctgtgtggtttgagatttaggagtgaggggtaagtggtataagataagcatagagaggtagagaacagccaagtcaaggaggagctaagccattttggtaatatacatctcataggctctttaacagttgagaaaaatgtttcaggtggtgagtgttagcacctcttttacaatcttgtgacaaagaaagcaagttccagaccaaattctagcacacctaaagacatctattaaacagatattccttagtgagccaggcccaaagcagttcacacaaactattctagaagctccatgctgtcccagctctttctgcctctagttattccaaccaccacttatgaaaaaggttcactcataatagaactgacaatatcccagaggcagggttctgttgcccttggagtcacatcaggcaaccagaaatcctaaccaaaggccaaaggatcattaaggaattacgcctcaggcgccatctccaagggaagaagttacaggccctgctagattcatattccttcttcatgcaagcataggaatatttcagggtctcgctttgttgcccaggctggtgcagtgacaggatcatagttcactgcattatttgggccctaactcctgggcccaaataatcctcctacctcagactcccgagtagctggaactacaggcacatgctaccatgcctggctaattttttcattttttgcagagatagggtcttgctctgtagctcataagccaccacatctggcccaattctgcttttgaatacttcaatttcactaatgagcgcctacttctaatactcattttgttaatcagtaagacactaatctcaccagtaaaaattggccaggtgcagtgggccatgcctgtaatcccagcactttgggaggccaaggtgagtagatcacttgaatccaggagcttgagaccagcctgggcaacatggcaaaaccctgtctctacaaaaaatacaaaaattagcaaggcatggtggcacgcgcctgtagtcccagctactcgggaggctgagacaggaggattgcttaagcctaggaagcagaggttgcagtgagctaagatcgtgccattacgctccagcctgggcaacagagacccccgtctcaaaaaaacaaaaaaatccaagctgtttctgacagtcactatgctaactagtaaaggtgttgatcaaactatagagagtgctgcactgatggcagcccctggagagtgcacccttgaagatgtaaagctaggtgacatcatggaatgtggatgcttcattaatgtaattcacattcccctgaagttgaggctgaaactaactggcaaatatatactatcagatggtctatgaagaagtatttttaaataaattacagacatcataactccatgataaagactttaaggatgatggaagtcagcgaagagttttaagctggagacagcattactgttaatagatcttaggtgagaggaatctgaccaacgttatggccccccctgtaagctttacacacatagctctactctgacttctccttgcaactgtactgtcccctagccatatgtggctattctaatataaagtataacttaactaaaactaaaacttcagttcctcagtcccactagcaaatttcaagtgcctgatggccacatgtggcttgtgtcttctgcactgacaatacagacacagaacatttccatggtcacaaaaagttctactgataccgctgatctagaagaataaagtttcaagagaatgataaatttctggggatggaaaataattcaaggccaggcatggtggctcaggcctgtaattccagcactttgggaggccgaggcgggcgggtcacttgaggtcagaagttcgagaccaacctagccaacatggcgaaaccctgtctctactaaaaatacaaaaattagctggacttggtggtgggcatctgtaatcccagctactcgggaggctgaggcaggagagatgcttgaacctgggaggcggaggttgcagtgagccgagatcatgccattgcactccagcctgggcgacagagaaaaaagagaagagaagagaagagagaaaagaaaagaaaaaagagaaaagagaagaaaagaattcaacaaagagaaggcatccatagataaattcaatgaagaaagtatttaggttctgagttaattccttgatcatcttgatcttcctcctgaaaaagactgccatttagcaaagaagggaggaagaaaaaaaagaggaagaaaacagcccaggagagaaaaaaaaaataccctctaaagtaaaaatattgttttgtcttcccattccaccctactgatatttaaaaagaagtatgccagggaataaaacaacaaggccatgaaaaactgaatcaagtaggctgttaaaagcagttattggccgggcacggtggctcacacctataatcccagcactttgggaggctgaggcaggtagatcacctgaggttgggagttcgagaccagcctgacaaacatggagaaaccccgtctctactaaaaatacaaaattagccagacgtggtggcacatgcctgtaatcccagctattcgggaggctaaggcaggaaaattgcttgaacccaggaggtggaggttgcagtgagccgagatggtgccattgcactccagcctgggcaaaaagaacgaaactctgtctcaaaaaagaaaaaaaaaaaaagcagttctcttaggcaagtcctgaacacacactcaggaaatgaggtttcactctttgcaaatcccattagtggcccccaagtttctgtttgctaccatttttctcagtgttttattcgacctaaagtgctctcagtgttagactggaaaatgattttttttcttggcaaacttgtggttacaagatgtgcaataaattttaagtataattctgttttgaagacatggttttggagtcaaggtttgcttggggaacagggccctaaaacgataaagtaatttgaagtatgtactgcatctatttataaaaactgaacttgcacttaatcttgcaggactattccagttacacagtgaggcacatctaaaattcctaaaaaagaaactccagcaatcccctgatggcttgttgtttataaacactagagccaaacttaatctcgaggttgtaaaagttgattatataaattgggtcattcttgtcatgtccaacgaaatcagggccaggggaaagaacacccagggcatacagcacctgctccaagaattagattttccacaagcccagctgctgaaacgacctgctgtgactctaagactactttaacctaccactgtctcaccaatcagagattcccagctcccaaaaacttgacttgtgtcaatgagctttctttcaaagcaatacatactatttctttttctaataaaactcctaaccttctgtttgttctttggacataccaaagaccacccagtctgtgtgtataactcaaattgcaattcttgcttcccaaataaaacattagagatttgtctctatattttatttgacttcaacaaggttcacactgcaaatttcccagtgaacaggtgagatttcatcttacctcttttgctccacagcaaacgctgacttaaaacgtgtatgtaaaatgtatgtatgggctgggtatggtggctcacacctgtaatcccaaaactttggaaggccaaggcgggcagatcacctgaggtcaggagtttaagaccagcctggacaacatggtgaaaacccgtctccattaaaaatacaaaaattagccaggtgtggtggtaggtgcctgtaatcccagctacttgggaggctcaggtgggagaattgcttgaacccgggaggcagaggttgcagtgagccgagactgcgccagtgcactccagcctgggcaacagagcaagactccatcataaaatgaaatgaaataaaataaaatatatgtatggctgggtgcggtggctcacatctgtaatcctagcactttgggaggccgaggtgggcggatgacttgaggtcaggagttcaagaacagcctggccaacatagtgaatccctgtctctactaaaaatacaaaagttagccaggcgtggtggtgggtgcctgtaatcccagctacttgggaggctgaggcaggaaaatcgctttaacctgggaggtggaggttgcagtgagctgagattgtgccacagcactccagcctgggcgacacagcaagactccatcttaaaaaacaaacaaaaaaataaaatgtatgtatgtatgtaagtagaagggttacaagaatgatgccctaaaaactctatcaattttttaaaccattttattacaaacacaaaatgcaggaaattacatagaatataaagcttaatgaatgattgtaaggtgaacatccttataaccactaccaaggtcgagagaaagaactttccaggcattccccaagttcctccatgttccctgatccaaccacaatcccctcctccctccaaagtaatcactaccctggctttggtaataatcacttccttgcatttctttatggttttccacttacatgtgcatccctttctatagtttaggtcttgcctatttttaaaatttttgatacaatttttaagtctcttaattcataattcctccactccagcctactcctgcccatatcttttttttttttcttgttacaattcatatgttacagaatctgggacatttaacccatataacatcccataatctggattttctaattatgtaccttgttttcagtatttcttgcaaattgcagctatatccagaggcttgatcaattttggattttatccttttggcaaactttggtggtgggtaatgttcttttgtcaggaggcttggtttttgtttctgatgtcagcagttattgatgctcagtacctagaccataaggggttgtaaaatgatgctatcctatcattttgttttcatttgtaagttgaaataattttataaagatatatttctgtcacctactatatggttatctagtggtacaggaaaggcaggacaaatacttatttttttcctttatccagttttcaatacaatgaactgatttcttatcaattctcctaatttagccaagtaggtttcctttttagtaacattatgagtgcctggatttaaatatatttatgagttttaatctattgcaattcttaccttactgaaactcaaattatccctctttggtcagtgggagcctcttcaagttagatcctaagtcctttcaagatgactccagtagactttgataaactttcatgttatctgttatcacaacattctaggatcatcctatacatttcctgccctaaaacctagaattagccatttccctaagaaaccccagtttctctaaatgggtaaatggtatttcaagatcataatttgggcactaagaatgttcattcatactgggttggtcattgtttctagaccttttagtggacagacacacacacacacacacacacacacaccacacccctacaggggaccaggcaggtaacaaacaagtgaaggtgagagaaatgaaacagggactgtggcaatctgaagagggtacgctctgcctaaaggggacagatcttacaattcctcaaaaggagccagaaataaaaaatttccacatgaatttttaaaatgctgactactaatttcaaaaaagtcaaacaccagggtcaaatgaaccacatctgtggggccagatgtgatccaagggttatgtgcaccctcaacctgaaaatgttaactcgcagttacaatattccaggagtcacattgttgctaatatataaaaaatatttagggaaattaagaattctcagactgcttcagaaaaaccccagctacattaagattatcttcctctccccaagtctctacagcactagggagaaaagcattttctgtacagaaaccatttcctttctcagacacgatgtgaaagggaaaaagccagttatccaaataaactcttaaagggagttaacctaacaatgtttttacatgtaagttcttggaatcacaagaagagatccaggagatatattttgcatgacagatatattagaggaaacaaaactggtagaaaactttattgaaaatgcttgatcaagctcttgccttcatttttacccattccaaaaagaaacaaagctaacagcactgctacctctgccctagcacacacctggacatagcagaaataacagaaagtgactggggaagaaaaaataaggtgtgaaaactctaaatatggccccagagaaggcttggggaaggacccgttatcaagaaataactgattgagtttggctcctctggtataagctaccatcacataacctgacccaagctccagaaaggataaaaaaaaatcacaggattaacgttttcagttcaaagacaagaaaaggtcagactggattaaagcaaaaccaaaagagtactcacggggtaatttcccctagtgtctgctactgtctttgaaagaaaataaaggcctcaaaccatccaagggaatccaaggctttaggaatcccaagcaaaaggaagatgggaactagaaacttcccagactgcaccatgagcatctcggtaagcctcgcctggtctccctcgaagccttacagcttcagcttctcggtcctgtgcactcggctttccttcactggagcctcctgcccctgagcatgttagggctatttttttccgcatgctatcaaatcataacattttaaacctctctctaatttggaaactaggctctcagccaaggtcagagaaagagttgagttgccggatggaaccagatgggctcaaactaccattctcataagtgattcaccagggagccagatgcagcatcccctccctttgatcttgtgtctcatgaaggaaaggaagaatagtttcacctctggcactgatcagacaccagtactctctagaaattccaccagcagaatggaggcatgtttatagtgtcaaaggaggaagtacaaactaacttttacagttcctttgacttcaaaagatgaattattttcttttcccctcatcgccccacatactggtgatcatgtcctttcatgaacatttgaatactaataatcatagctaatatctatcaagccctcatcagactctgttctaaacacttgacatgtattaaccctttgcagtaggtactattatattatccctgtggaagcagagaagttaaatagtcacttgctcagggtcacagagttaataagtgtccaaatgaagacatcagagcctgtactctatttccctcttttttattataaattttttcaaacatgcagaaaagttggaagagtaatacaataattaaccatatatgtctagattaaatattaataccttgccttattttatctttctgcatgcatatatttatttttgctgaaccatgtaaaagttgaacacatcatgacatttctctccaaaacacttctgcacacagttgtgcaaaataaggacattctcctatataccataatactatcatcacatccaggtaatcaacaattcccagccggcgcagtggctcacacctgtaatcccagcactttgggaggctgaggcgggcggatcacaaggtcaggagatcgagaccatcctggccaacacggtgaaaccccgtctttactaaaaatacaaaaaattagccaggcgtggtggcaggtgcctgtagtcccagctacttgggaggctgaggcaggagaatcgcttgaacctgagaggcggaggttgcagtgagccgagattgcaccactgtactccagcctaggcgacagagtgagactccgtctcaaaaaaaaaaaaaaaaaaaaaattccctaacatcatctaatatctaatctgtcttcaaaattttctagttgtcccccaaaacatcctttatagctgtttttttcaacccaaaatccaatcaagactctcccattgcattcagttattgtgtctctttagtccagaacggtttctccactttttctttttcataacattaacattttgaacagactcagaccagctttcttaaaataccatagtacattctggtttgtcttactgcttccttgtggtgtcattgaactcgttcctctgctcttttattccctaaaaccaaaactcagatcttaaggcttcattaagggtaactttttgggtaagaatagttcagagttgataacgtgtattttgtactgcctcatgccaagcactatatatatcatgtcaagttgttccactataagtgataagagttggattacttagctacagaatatgcctttgtaaagatttttgtttgtttgttttgtttcgtttgtttttgagacagtctcttactctgtcacccaggctggagtgcactggtgtgatctcagctcactgcaacctccgtctcccgggttcaagcaattctctgcctcagcctcctgagtagctgggattacaggcacccaccaccaagcctggctaatttttgtattattagtagagacagggtttcaccaccttggccaggctagtcttgaacaactgacctcgtgatccacccgcctcggcctcccaaagtgttgggattacaggcgtgagccaccatgcccggccataaatatgtatttttccctttgctattagcaaagaatctagagggtggggactagggaataatgttttgacacaatgcaaatgcaaatacattgttctctaaaaaccattcacccagtgattttagcatccatgtgatatgcacaagaggcaggtagaaaagggccgttcctggcgacggccccaccctcaagcctggacccctgacctaaagtgagaacttcacatccctgttgccttttccaaaaccaccctggcctggcctgccccgcatcctgtactcataaaaaccccaggctccactggcagtggagtggcagagagggagagagaagcagcagccagaagtcagagggaagcagcttgatttcagacggacaccttgatggcgggacctcggagaagagttcagccaggaatgaccgaactgaggggaagaccaccttcctgctccatcccctttccagctctccatcccattgacagccactttcatcagcaataaaatcccctgcatttaccatctccaattcatttgtgcaacctgatacctcctggatgccaaacaagaggttgggatacagagggctgtcatactgagatgtgaaatgcttaagccatcagaggatggcaaagctgaaagagcacagtgtaacaaacaacttctgtggctccagggatcatgagtaccccactagacattgctgtgggactgcacagagttgtgcacagagtctgtgccatgggactgcacagagttgtgcccagactggtcttaaactcctgggatcaagtgatcctcctgcctcagcctccctaagtgctgggactataggtgtgagccactgcacccagctataattcctttttaaaaggcagagtaattgcttagttctttccttttaattatttactttcagagtgagaaactggtaaaatagccacatctgatgatggtctatgtattttttctcttcttgcccttttagtgagcatcactatggagacatgacttttttttttttttttttttgagacaagaatcttgcactgtggcccaggctggagtgcagtggtgcgatctcggctcactgcaacctctgcctcccaggttcaagcgattctcgtgcctcagcctcccaagtagctggcattacaggcacccaccaccatgcctggctcattttgtattttcagtagagaaggagtttcaccatgttgtccaggctggtctggaactactgacttcaagtgatccacctgccttggcctcccaaagtgctgggaatataggcgtgagccaccgtgcccagccaaacacatggatttttatccagtgttttataattacttgttgtcattcttttgatgctcagaaattcccaaatttgggtggtatgagcccctttcagctggtaccagtgtttttctgacttagtcctgttaagactttgaggactattttgcttttttttgttgttgtaacaagatgtcccagtcaagctgtgctcttacatactacattagacaacctttcctagagggctatgcctacagagggcttgaaaaaaactcagagaaaaagataatgtcaagagcagatgtgtcagctcctagaggttatcaaatccattttgatttggaagtagaaagcattctgaagccgatcagggtacagccactcactctggcacttacagctttgctacaactccccagcaagtggccattcagcctctggcctaaacaccatgattcacagggaactgacctcacttaggacatctcattctgtcacagaactaccttatactaagcttcttgtaccacctaaccattagttctagcttctctccttggagcctatggatccctgtgaaactcaactctaaagggtccacttagtagtctggcagaaactcagccctaaagaataattttaggctggttgtggtggctcagcctaatcccagcactttgggaggctgaggcgggaggattgctgtagctcaagaattcaagaccagcccgggcaacaaagtgagaccctgtctctaaaaaaaaaccaaccaaccaaccaaacaaacaaaaaacaaaaaacaagccagccatggtggcacatgactgtagtcccagctactcagtaggctgaggcagggggactgcttgaacccaggaggtctaggctgcagtgagccatgttcacagcactgcactccaacctagttgacagagtaagaccctgttacaaaacaaaaaagaatatttcctcttctgtttccaccttcactttttttcaccttttttgttttttttttgtttttgagatagagtctcactctgtcacccaggcttgagtgcagtggcgcaatctcggctcactgcaacctccaccttccgcgttcaagcaattctcttgcctcagcctcctgagtagctaggactgcaggcacatgtcaccatgcctagctaatttttgtacttttagtagagacgcggtttcactatgttggccaggcttgtctcgaactcctaacctcaggtgatccacccaccttggcctcccaaagtgctgggattacagacatgagccattacacctggctcctccttcatatttaaacagatggttttgtttcctggatgtgactacactgatcttcaaataccctaccatgacccacaaggcccaggtgatataatttggctgtgtccccattcaaatctcatcttgaattgttgttcccataatcccctcatgtcatgagagggacccggtgggaggtaattgaatcatggggatggttacccccaatgctgctgttctcctgatagtgagtgagttctcacaggatctgatggttttataagggtcttttccctctttgcttggcacctctccttcctgccatcatgtgaaggtggacgtgtttgcttccccttcggctatatttgtaagtttcctgaggcctccccagccatgtggaactgtgagtcaattaaacctctttcctttgtaaattaccaagtctcaatatcatactgaatggacaaaagctggaagcattccctttgaaaactggcacaagacaaggatgccctctcttaccactcctattcaacatagtattagaagttctggccagagcaatcaggcaagagaaagaaataaagcgtattcaaataggaaaagaggaagtcaaattgtctctgtttgcagatgacatgagtgtatatttagaaaaccccaccgtctcagcccaaaaactccttaagctcataaacaacttcaacaaagtctcaggatacaaaatcaatgtgcaaaaatcacaagcattcctatataccaattatagacaagcaaagcgccaaatcatgagtgaacgcccattcacaattgctacaatgagaataaaatatctaagaatacaacttacaagggatgtgaaggacctcttcaaggaggactgcaaaccactgctcaaggaaataagagaggacacaaacaaatggaaaaaaattccttgttcatggataggaagaatcaatatcatgaaaatggtcatactgcccaaagtaatttatagattcaatgctattcccatcaagctaccattgactttcttcacagaactagaaaaaactactttaaatttcatatggaaccccaaaagagcctgtgtagccaagacaatcctaagcaaaaagaacaaagttggaggcaacaagctacctgacttcaaacgatactgcaaggctacagcacccaaaacagcatgctactgctaccaaaacagagatatagaccaatggaacagaacagaggcctcagaaataataccacacatctacaaccacctgatctttgataaacctgacaaaaacaagcaatggggaaaggattccctatttaataaatggtgctggggaaactggctagccatacgcagaaaacagaaactggacccctttgttacaccttatacaaaaattaactccagatggattaaagacttatacgtaaaacctaaaaccataaaccctagaagaaaacctaggcagtaccattcaggacataggcatgggcaaagacttcatgactaaaacaccaaaagcaattgcaacgaaagccaaaattgacaaatgggatctaattaaactaaagagcttctgcacagcaaaagaaactatcatcagagtgaacaggcaacctacagaatgggagaaaatttttgcaatctatccatctgacaaaggtctaatatccagaatctacaaggaacttaaatttacaagaaaaaaaacaggccaggtgcggtggcttatgcctgtaatctcagcactttgggaggctgaggcaggcagatcatgaggtcaggagattgagaccatcctggctaacatggtgaaaccccgtctctactaaaaatacaaaaaatgagccaggcatggtggcacgtgcctgcagtcccagctacttgggaggctgaggcaggagaatcgcttgaacctgggaggcagaggttgcagtgagctgagattgtgtcactgcactccagcctgggcaacagagcaagactcaagtctcagaaaaaaaaaaaaaaaaagacaaaaaaaaaaaaaccaaacatcaaaaagtgggcaaaggatatgaacagacacttctcaaaagaagagatttatgtggccaagaaacatgaaaaaagctcatcatcactggtcattagagacatgcaaatcaaaaccacaataagataccatctcacgccagctggaatggcgatcattaaagtctggaaaaacagatgctggcaaggatgcggaaaaataggaatgcttttacatttttggtgggaatgtaaattagttcaaccattgtggaagacagtgtggcgattcctcaaggattagagccagaaataccatttgacccagcaatcccattactggatatatacccaaaggattataaagcattctactataaagatatatgcacacgtatgtttactgcagcactacttacaatagcaaagacttagaaccaacccaaatgcccagcaatgagactggataaagaaaatgtggcatatatacaccatggaatactatgcagccataaaaaaggagttcacgtcctttgcagggacatggatgaagctggaaaccatcatccttagcaaactaacacaggaaccgaaaaccaaacatcgcatgttcttactcataagtgggagttgaacaatgggaacacatggacacagggaggtgaacatcacacactggggcctgtcatggggtgggggacaaggtgtgggagagcgttaggacaaatacctaatgcatgtggggcttaaaacctagatgatgggttgatacgtgcagcacaccatggcacattacataggtttgttatacctatgtaacaaacctgcgcattcagcacatgtattccagaacttaaagtaaaatttaaaaaaaaattatttcatgtaccatcagcaaaaacaaataaataaataaataaccaagtctcgggcagttctttttctttccttttcttttttttttttttctttttttgagacagagtgtcacttcatcacccaggctggaatgcggtggtgcgatctaggctcctgcaacctctgcctctcgggttcaagcaatgttcctgcctctgcctcccgagtagctggaattacaggaacactcccccatgtctggctaatttttgtagttttagtagagacaaggtttcgtcatgttggccaggctggtctcaaactcctgacctcaagtggtccacttgcctcagcctcccaaagtactgagattacaggtgtaagctaccacgcctggctcaggcagttcatagcagcgtaagaatggactaatacaccaggctacttcatatatttataaaaaatatacaaatatagtaggaaatggagttttaatttctgcataaatgggatcctgaagttcatctcaaactccttccgctcctgtcccccacatacagacggttaccaagcacagccaattctacctcctagaattcccctgcatctagtctctcatctctccatctcctctgacactggtttgggcccccagtttacccctctgacttgatctagtacaatgttctaagctttcccaacttcagctcttcctactcccatctacccgacaagctgctgccaaagcaatcttcctggagcactcacctgctcagcatccttcaattgctttatgtctgcagtctggcatagtatctagcacactataggtacttagtaaatattggtagaggagctgcttgacttaatgagtcagttgtactgtccactagtgtcaggaggaaatttcctttagttttaaacaaaagttgttttatataaagtggtgcatagagattggcttaagaaaccatttttatcttcttttatttacttattcattttttgcaggttggacaagctcagaaaccatttttaaatttctggtccatccatgtgtatgaatatactatattatttatttgatacatagttgtataaaaagtctggctatatatattcttagtgcttagactttctaaagaataagccataaataggaaataaaaaagaaaatacaagcagcacattgttatgtggaaaaatgcttcaactcagcaagaatacagaaagaaaatcaaagcaaaataacttcactgtatggtgacacatctactgaactggcaatcataaatcaaacttgaaaagtcagtgctggcagatgaggaggtaagtggtccacttctctttagatactgatggtggcactgcaaactggctcaggctttctggtgaacaatctggtataattgcctaataagaacaatacgacttttcaccttgggtccagtgatttagctaaagcaacatacttgaagaaaataatttcaagctgggcacagtggctcacacctgtaatcccagcactttgggaggccaaggcagaaggatcgcttgaacctaggagtttgagagcagcctgagcaacatggcaaagccctgtctctacaaaaaaatacaaaaattagctgggtgtggtggtgcatgcctgcagtcccagttacttgggagggtgaggtgaaaggattgcttgtgcccgggaggttgagggtgcagtgaaccgtgactgcggcactgcacatcccatcctgggcaacagagtgagacactgtctcaaaaataagaaaaagaaaaagaaaacaaataaaaacaaatttctggctgggtgaagtggctcattcctataaacctagcactttgggagaccaaagtgggtgggtggatggattgcgtgaacccaagaattcgagaccagtctgggcaacatggcgaaaccccatctctacaaaaaattagccgggtgtggtggcacacacctgtagtcccagttactcaggagactaaggtgagacgatcgattgagcctgggagatggaggctgcagtgagctgagattgtgccactgcactccagcctgggtgacagagcaaggacctgctctcaaaaaaaaaaaaaaaaaatttctacgttatttatattagtgacaatataaatgacatatctcaaacataaataaagacatatctcaaattccccaaataagaaaaagatcaagcaaaccatgaatcattgtctgcatcaacacaatattataaaatcacttaaaataacatgcatatggcctatttcaataaatggaatacacactcagctttagcagtgcttgtgattaagaaaggctctgaaatcagacatttctggcactgccacctgtacactttcaagaaacatttatcttgtaagaatggatttggaccatgtggggcctgcatgcagttacttcctcttgaagaaacatgtatgtactattctcatttgagtagaacaagatgattagagagcacgctctggcatcagatggccatggttcatatcttagcaatgtcattcgctggtcctgtgaccttaagtgacttaacctcccaacattctagtttcaattcatttgtctaatatggctaacactagactaatatttggctaataatatgacctactccataaagttcttatgaggttaaaatgagacgatgcctacagagtgcttagcatggtgcctgacatgtaatccattctcagtaaatgtcagcaatttgcattcttcaattaatgtttattgatcagccactatgttccaagcattgtttcagatgcacatactccatttaagtcctataagaatcttacaaggtgagtgttattataaagaaaagttaaagaaatgagctcagaggggatcactagttgagaaaagaaaactgcaagatagttgcgtttgcaaatatgtaaaataaaatgcacttatacattcccaaggatatgcatatagtagtgccccccttatctgaggtttcacttttcatggtttcagttacctgttgtcaactgtggtccttaaatggaaaattccagaaacaaacaattcataagttttaaattgtacaccattctgagtagtgtgatgaaatctcacgccgtcctgctctgtcccactcgagacatgaatcacccctttgtctagtgtatccctgcctgttagtcacttagtagttgtctcagttattcgacagaaaaaacatagtatacgtagggttcagtaccaaatgcagtttcaggcctccattaggggctttagaacatatcccctgcagacatggggaggtctactgtagttgggacttaatgataattaagtccactttgtttaaagttagtcaagtttctatgtgtttatattttcaactgggagcaagcttcccactgcctttactaacccgtgcccttcctttcccccagcagggaccaggccatgtattaaatgtcacttgggtgctggcttctgaccagcaagtgcttacctggaggagatagaggagtcctgggacaaacaaggtgagtgggtacagagactggtatgtcgctaaggcaagaaaaatagcactgaggaaagcactgcctgtaaaaagaaagaaatgtatggaataatccagcctcatcaatcatgattagactcagcaagtccctctcaacacaaaactttccataactgctcaaataatcacctgccaagtgcctcctggtacacaaggtgctatgcaaattcacacagtaagagcttcttggcttgatttccaatgaaaggaaaccaagaaagtcaaaaccatctacctttggcaacctgagacactacaggcataattcttataaaattttgagacccagaacgattttacaaaatttcaacccgaagatgtataaagggatcaagtctattaacatccatgtcctatctaatgtaccaatttattaagcctacaattattgcttatgatatccagagctggaaacccatccctttgactgttgcaacattatcactctttacaacagcccttccttacctgctgcatcaatttaggtcacgttttttcttttcaaatgaaagtatattaattttgttagtaatgtcctcacttcctatataaaatggactactatggaatcattaaacatgaggctattaagaatttgcaatgacttagaaaggtgtttataatatcctattaaatgaagtttataaaagagacatatattatcatttattttataaaaaaaaaatgcacaaacattttttaaaagacgaaaagccagcaggcaaagtaactcacgcctataatcccagcacttcgagaggccgagtcaggcagatcaagatcaggagttcgagaccagcctagccaacatggtgaaacctcgtctctactaaaaatacaaacattagccaggcgtagtggtggtgacctgtaatcccagctactcaggaggctgaggcagaagaattgcttgaaactgggaggcagaggttgcagtgagctgagattgtaccacagcactccagcctgggtgtccaggcaaaagtttgcagtagggggcggagccctcatggagaacctctgctagggcaatgcggaagcgaaatgtggggtcggagcccccacacagagtccctactggggcaccacccagtggagctgagaagagggtcactgtcctccagattccagaatggtagatccaccgacagcttgcaccgtgggcctggaaaagccacagacactcaacaccagcctgtgaaagcagctgagagggaggctataccctgcaaagccacaagggtggagctgcccaagaccatgggaacccccctcttacatcagcatgacccagatgtgagacatggagtcaaagaagatcattttggaactttaagatttgtctgccctgctggatttccaacttgcatgaggcctgtagcccctttggtttggccaatttctcctatttgtaacggatgtatttacccaatgcctatacccccattgtatctaggaagtaactaatttgcttttgattttacaggctcacaggcggaaggcacttgccttgtctcagatgagactttgggctgtgcacttttgggttaatgctgaaatgagttaagactttgggggactgttggaagggcatgattggttttgaaatgtgaggacatgagatttggaggggctgaggcagaatgatatggtttggctgtgtcctcacccaaatctcaacttgaattgtatctcccagaattcccatgtaatgtgggagggacccaggggaaggtaattgaatcatgggagttgctggtctttcccatgctattctcgtaatagtgaatgagtctcacaagatctaatggtttatcaggggtttccgcttttgctttttcctcattctctcttgccaccaccatgtaagaaatgccttttgccctccaccatgattgtgagaccttccccagccatgtggaactataagttcaattaaacctctttctttcgtaaattgcccagtctcggactaccaaaaaaaataaaataaataaatagaagactaaaacctaaggccacaaagtttatagtggttatctctgggtagtggaattatgaacaatttttcatttttgcttcactgcattttttaaactttctaaaatgaacatgctttgtttttgtcattagaaaaaagctaatttctttgaaaaaatagctattccctttcagatggcttaagacaacaggatactctaaaactaaggatagagagccctagtttacaacaggagtttccaagtggcccagaaatcagtaggatgcaactgatggtccaagatataaagcccaacaggtgtcttgtaatgatgttttttaaaatgacaatacccatgctcactctcattagtgtggggtcaactatttactgaaaataacaggcggggcatggtggttcacaaatgtaatcccagcactttgaaaggcaaaggtgggaggactgtttgaacccaggagttacagactagcttgggcaacatagtaaaaccccatctctacaaaaataaaaataaaaaaataagctgggtgtggtgttacacacctgtggtcccagctacttaggaggctgaggtgggaggatcacttaagccctagaggttgaggctgcagtgagctaagactgaaccactgcactccagcctgggtgacagagtaagaccctgtttcaaataaaaaaataaaaataacacatcctctcaatggtgtttcataaaaggaggaactagtcactccagtccaaggagttttacccctctgctaatccagctctagagacaaacaggaagagattattgatgagatctttcaccaccaaagtggtctgtatacttgaaacatctaaaaactaccttggaggacagacggttataaatgtgacaatgtcacagacgagagagtggagagaaaagaactttgtgtgctttattcttcaaaccaaggaaactcaccagctagaacaaccctagttgacagaaagtagaagggaggcagagaaagagagaagctagaagtaataggacagaattctatgggaaggggggctgtctcgccatattgacagtgccagtcatgatgtcctgtatccagggtactcataaatatgactgtgtaggaacaggatcacgcccagctaagctgtgacaccagcagtggcaagcacacatctgctgagccacagactctaaactcagaaccaggtcactctgggatagggcagtggcagtagtaggaaaggtgctgttctggagcccaacagctagggtgggctagggattgattctttgattgggtcaaaaatctgaatgattttttggtgggaaactggccaagagagggaaaacactgaaaataactttttaacttaacctggttctctacggattgaaagcaggcgagagaagaggcccatgtgtctgttactagaggatggaggctaatgctccaactccatccattcctatagcatggtgaaaacaaacacatgactttctcctgtctctcccagaggagacacaaggagtgaaatcaacacagccatctcttgccctaattgcctgaggttaataattgcttgtctgaaactgactgtttatgaggcccaagagagaaaaagaggctcacagcctagccaaatggacttgtgagttttagaatacttgctcctaggatcaggaagaagcagtcttccttccatagactgaagtagtctttgggaaggaaaaatctgttcctcctgctattctttgtcagtaactggcatcaacatctagccagataccctggcaacccttcacccttcagctcccatgttcttccttccaccagtcaccaagccctgtggatccacccctggagcatttatcctttcagttcttgctcttgtcatctctctccagcagcttttccccctcctccttagcggtctcccaaccacctcccatccaagtccatctacagaagcaccaaaggaaccttctaaaacagtttagattgtggctagccagtctttaaagacttctgatggttccatttcatctatcaggttaagtctaaactccaacagcaaacaagacccttcaccactgggtctcatttctccagtttcacctctcaccactcttccacacacgccctgtcctccagctacactggactattcccaatttctgaaaacatcatgctgtttcattcttctgtgtctgttcttaggctattccttctgcccaagccatccttctctgcccgctttctagtagaaagcattcgtttgatagccaggtgaaaggtcactttgtctatgagcccaagcaaaggtggtaacaaccgttgattatagttgacatttatggatcacttgctaggtgccaggcactgtactgtatcctctgcatcaagaacagttcctgacttggacaggcgcggtggctcatgcctgtaatcccagcactttgggaggctgaggcgggcggatcacgaggtcgggagatcgagaccatcctgactaacacggtgaaaccctgtttctactaaaaatacaaaaaattagccgggcatggtggtgggagcctatagtcccagctactcgggaggctgaggcaggagaatggcgtgaacccgggaggcagagcttgcagtgagccgagatcgcgccactgcacgcgacacagcaagactccacctaaaaaaaaacaaaaaaaaaacaaaaaaaaaaaaacaaaaaaaacagttcctgactcaaaaaggtcctcaggaaacatcacaacagccctgtgaaagctctatttctgcttcttagaacagctttactgagataaaaaccacacattctacccattttacaggtcaagaaatcaagacagaaacagaaagcttcagtaatgtgaccaaaaccacatagctgactccggtacccactcttaatccctgtgttaataagcctaatactgatgctatcttataataatctgcatatgtttctctctctccccatttctctgtgagtttctcaagggcaacacatttatcttaactttggctctccagcacctagtacagttcctggcacatgtgataaatgaacaaatgaagaaatgaatgaatgaatatcattcagcaatacatatgaaatcctttttaaaaatatgagaatattaaaggaaaccaatgttcttgaggaagaaaaacttatgaagtgtaatacacagagtcatgaacacaggcaaagcacaaaataaatctaactcaaataaagcagagcctgaagaatagtggttgagggtttgttgtggcagagggctggcacagagaatgctctctgtggagtaaactattgcatggctgaggcctgcagtctgggggcagaaacacagtgctgcaacagtcagtaggttggtgtgtgggaagtctgagtgtgggatgctgggacaggtgtggacagggcggacgcacagccggagcaaaagtgagggtgagtatggaggcaggcaggagactcagaaagggctatgtgttttgaaaaaagcttgaaggggtaaaaaggagttaggaaggcagaggaggaatgatatgtgcttggggcagagtcagagaagatcaaggaaagtgagaagtgacttcaaatattttaaacaaactgtgcaataagcaaacatttctggagtttgctctatacgaagagtgtgatgggtgccaggaaacctggtgactcagatagtctctgtcctcagggagctcccagtaaacaattacaaaatacaggaggaaagtacaaaggaagcagacctagcccatcaggggaagctgacacctgagttttgaacaatgagtaggtgaggctgggcagtccaaggctgtgcacaggttggagggcaagagagaatggtgtgctggggtggggctgtgtgtactgtaattagctcaatatagccaaaacagggcaagagctgggaggagtgacaggaaagagaacacaaaaggggctcccgtggatgctggtaccactcttccttaatctgggtgctggttactcaacgtttcgtgaaaattcacgtatctgtacactaatgagttatacatttttccgtatatatgtcatacttcaataaaaagttacaatccggctgggcgtggtggctcacccctgtaatctcagcactttgggaggccgaggagggtggatcacaaggtcaggagttcgagaccagcctggccaatatggtgaagccccatctctactaaaaatacaaaaattagccggatgtggtggcgggcgcatgtagtcccagctattcgggaggctgaggcaggagaatctcttgaacctgagaggtggaggttgcagtgagccgagatcacgccactgcactccagcctgggagacacagcaagagtccgtctcaaaaaaaacaaaaacaaaaaaaaagttacaatccaaaaagtctcagcaagcaggtaggagtcagatcacggagggctaagcttgcacagtcatccaaaaacatctacctacaggcccagacaggatacctgaaatcatgtctgaaatggcagcctcatgtgggcaagagctagggcatcacgctggcctaaccagaaggaactgtgccaagaggactaagagttttaccccaaaatgatataacctaccatttgctagggcagcccagatgcacaggcactaggctttctatataagccttgatatttagccttatcctagggatattagagtaaatcagtcaaatgtgtatgtacattggctgtagtatcaggaaatttcattatctactcaatctagctttgaatatgttatgttttctaactctctatttgtgtcagggtgggggccaaaagcctcagcaagaccgggggtaatactttgcctccagggactgcacctcacagcgatctgggcctgggtgggtggcacagctacaggagtgagcaggaatgtaatgaggtggggccatggggactggttcaggacagggacttcaagtggagtaatcagagaataaagagattgggtcacaggtgatgatctataccaagacaggcagaaacgcactggaatgtagtcaaaagggctcaggtcccacaggactatcagaaaaggaagttgcaccagggtgtggggcaacaagtgagactgcccaggaggaggaggagatcctgggggcagggccaatgtattacattccttgccaagtgtgttcttttaacggggcagcctctctcagagcaatccgtacatatcagtgataacgatgataatttattgagcacttactctgttccagccatgactgtaagcactttacttgccttaagccatttagtcttctcaataattccatgaagtgggtacaattactgtccccattttacagataatgaaactgaaagacagagaagttatttgtctggggtcacgaaactagtgaatgagagcaataggatttaaaccaaatggttttacttcagaccccatgttctgactgcatcactgggccaccctcttgatctcaatcaagcaccataaaaataacaataggcagagcaactagttattgagtggattctgctaaggaagcacgctaagcattttatatttcttatttattcctccactatctctaggaggtagatattctgggatcaaactgaggctcttgaggctgcatgatttgctcaaggctacagagctggtaattagaataagcaggctttgaagttgggttgacctgacaaaaactgagtccttgagtcctctatgactccttccattggcagggctttggcctacaggaacctcaactcgaagtgatgggatcaccaggcctcaggatcatcactcttccattgttcctctaaggctaggctccaggaagagaacctcattgaaacctcccaggtctccctataaggcctataaggatgctaacaatcatgaggtctcttttattttttaattttttttacatggtctcactctgttgcctagattggagctcagtgacgcggtcatagttcactacactcaaactcctgggctcgagtgatctgagggatcttttaaaagggaggatactattaaaaatagcaaccaataccatctgagcagttattacacgcctccataccattcattctttatattcactctataaggcagacactctttcatccccatgctgcagataaggaaactgaggcttagaattgttaagtgacttgcccaaggtgatagagccaggagacagtggagctgggattagccaccagatctgtctaacatgagagcagcctgggctcttaatcatgcttgaataccttctgatagcactgatccttctttctccttggcaagcaagtcctgtcacatggccttttttggtggcataaggaaagctggaagaacccttaggtggcaaacttcaagaatatctcgctgttgacaaacaccaatggtgaaaaagcaggaccatctattagcatctgtttgtctgttttcctttttaaagcctaatgaagactacttcccaaggaaggagtttttaattagctcactgaaaggcagagtacactttgcccaagcaacagccttcaaagcgaaacttaagctgctccactaaactaatatcaacctgcccaaagacctgtgttccccagccaacactacaataaggacatcacaatacaatggcccgaggcttgtcctggcctgcatctctcagagtgtcccaggcaaccctgggctgccacaaaggaagccaggggaaagcaagcagcaagagtcaaggggacaaagcaaacaaggtcactcccttctgtggtgtatctgctccatggaagtctggggagcattgctaagtttacttccactgcccctatcgtcttatcaatcaagttaatttaatttcgtttttaattatgtactcactgaagaaactttggaaaaaaaacatatgaggccgggcgtggtggctcacgcatgtaatcccagcactttgggaggccaaggcgggtggatcacctgaggtcaggagtacaagaccagcctgaccaacatggagaaaccccgtctctactaaaaatgcaaaattcggatgtggtggcgcatgcctgtaatcccagctattcgggaaactgaggcaggagaatcacctgaacccgggaggcagaggttgtggtgagccgagattgtgccattgcactccagcctggggaacaagagcaaaactccatctcaaaaaaaaaaaaaacaaaaaaaaaaaaactacatatctatacgaaaaggaaataaaactcacccatgaacttaatctacaggaacaagtattatccttttgggatctattttctaactatttttgttgctttaacatagttgagattcattaaaatgctgggcacagtggctcacacctgtaagcccagcactttggaaggctgaggcaggtggattgcttgaggcttagagttcaagactagcctggacaacagagcaagatatggtctttacaaaaaacctttaaaattccgagattgcaccactgcactccagcctggacaacagaacaagactctgtctcaaaaaaaaaaaaaaagaaagaaagaaggaaaaaaagaaagaaaaaaacccaactaggcatggtggtgcatgcctgtcgtctcagctacatgggaggatggggtgggaggatcacttgagcctaggagtgtgaagttacagtgagctatgactgtgccactgcacttcagcctgagtggcctgggtgacagagtaagaccctgtctccaaaaaacaaaattagattaaaaaaaatacatatatataatatatatatatatatacacacatacacaattttacattgtttaaaaaaacatttattttcatgtagtttaaaattatatttaaatatcatgtgcataatattctactacatgggtaaaccatattttacttaaccactcctctctaaagtattttctaatttttccagtgattataaataattctgcgattaataactttgtaccataaagctttctgtctttatttctgcattactttaggataggttctcaaaagtagaataaaaatcaaaactacaaacattttatccccaggtggatagtgttagaaaaataaatgaataaaattttttaaaactccaaacttttttttttttttttgagacggagctccgcttttgttgcccaggctggagtgcaatggcgtgatctcggctcactgcaacctccacctcccgggttcaagcgattctcctgcctcagcctcccgagtagttgggattacaggtgcccaccaccacgccctgctaatttttgtatttttagtagagacagggtctcaccatgttggccaggctagtcatgaactcctgacctcgggtgatccacctgcctcggcatcccaaagtgctgggaattacaggcgtgagccaccgcgcctggccaaaaaaactccaaacattttaagactgcccatggttgtacaaatttatcagccaacttccatgtgggagaatatctatttgatagaacatttgccagaactgagaattagcttctaaaatctttaccaatttcagaggcaaaaaacaaaaaaagctttcaaaagtttttaaatttcaatttgccttttctttattaattatccatgagttgaatatttttccataattttcagtgatttatattccttttcttgtgaattttctcaaatattttcttttttaggataaaaagtaaattattccttaattttattaaataattttattaatattatgtggtaaaatgtgaactgtagaaatataacttgcagaagttataactgaactaactatattatatatactgttagcagagattactaaaatactcaaagagctggagtggttcagagacctagctaaaatagaactcttcaaatattttaacagattagaaatgttgtttgtgagggtctctatttatagtagcaaataatggaaaacaaatgtccaacaaaagagaagcgctgggatctcataacaaatacgcaagaggaactgaagtggacatgcagcagagtgatgaaagacttcctttccaatttataggtttgaatttcttttattcttaccaaatgcttaaactacttgcaaaattaaatttaaatttaaaggaaatgacaaatatgtgaccaatgtcagacatgattcatatgaaataagtgataaaagtaaaacaaaattatgtatataacattacgaaaatgtctatgaattcattaaacaaaagtctggagtgatataaaattttttttgctctgtggaacaaaaaaaaaaccatggctgtgaaagagatacatataacttacttacatgtttttcttccccaaacaaaaaccttttcgttgacttacaggtcataaaatatttttttttaatggcatacttttacatttttacgagcgactcctaggaaaacaaataaacatgcaccttctgagggcatgtcttcagtttctctatctttgcactcggctattttaaagatgacatttccaaaggccagtacttggtcccttctgccaggctgctgcgtatattgtttattttaatggacaccagacaccttgataaatgacaacctatctgaacctgacactctggaaacagggattaaggcagggagagttcacagacagcagagtatttactgttaagagttatttctgacaaaatgaccaccacgatcttcagaacaagacaattcaggctatgcaatatctagccattttaagtaatccaataataaattaaactaataggcctacagaaagaccactcataagcattccaagagaaacaatctcttataaagacctaaggcatcctcgggtgccaccccagaaaaggtaggcaaactgtaagtaaaaggttctatgtacaactttttactctttacttcctgagtacacaaactatttaacaatagtgtacaaatataaggactcttacacgcttcttatgggagtataaatgtggcaatacattccagaaatctgactgggtgtggtggttcatgcctgtaatatcagcactcaaggaggtagaggtgggaggacagcttgagcccaggagttcaagaccagcctgggcaacacagtgagaccccattatccacaaaaaggaaaaaaaatcaataaattaattccagaaattgttaaaaagtggcaaatatttctatttctaggacattataagaaaataactaaatatgagtgcaaaaattgctgtacattagaaagttaattgtaatatttaaacagctaaaaactggaaaatcacctaaatatttaatgatacatacattggttaaagaatttctatattcataaaatgaatatgcagccattaaaaatgatagactagaactgggcgcagtggctcacacctgtaaccccagcactttgggaggccaaggcaggcagatcacttgaggtcaggagttcaagaccagcctgaccaacatggtgaaatcttgtctctgctaaaaatgcaaaaattagccgggcatggtggtgcgtgcctgtagtcccagctacttgagaagttgaggcacaagaatcacttgaacccaggaggcagaggttgcaatgaactgagatcatgtcactgcactccaacctgggcgacagagcgagactgtctcaaaaaacaagatagatcagacatttattgatatatgttatatgtagtaggttgtattattggccccaatttccccccaccatgtccaggccctttgctgtataactttgccgtgccttcctgttgtgaacaggatggaaatctccacccctgggctcagccatgtgtaacttttttttttttttttgagatggactctcgctctgtcgcccaggctggattgcagtggcacagtctcagctcactgaaacctctgcctcccaggttcaagcaattctctgcctcagcctcccaagtagctaggattacgggtgcctgtcaccacgcccagctaatttttgtatttttagtagaaatgaggtttcaccatcttggctaggctagtcttgaacttctgacctcatgacctcatgatccacccacctaagcctcccaaagtgctgggattacaggcgtgagccaccatgccgggccatatgttacattttgatcaatgggatattagcacatgtgatgcaaccaggaacttaaaaagtgcatgcctgactaggcttgctcactattgtgcttctgccattgctatgaaaagaaaatacctaagtctgtcccctggcccaagaggatgacaaccatgtggagcagagcccaacctagattagccaactccagccagccactgacgtgaaaatgaagcccatgtaaccagccaactgacaagccatgtccaacctagatcagctgactccttgctgacttacagatgtatgatctaagtaaacacttgttgttgttttaagctactgaattctggaatggtttattaacatttttgtggtactagctaattgatacaagatttaaaagtctggagggaaaaatgttggaaaaatctggaaatatataacccaaatgcttacagaggaacttttagttaaaaataatagattgatcacatgtgtttatcaactctccctccaaaaatctcattaaaatgaaaacaagagattaaaaccatattaaatcacaaagaaaataaggggagattatagcaaaaccaactttaacacaatagtgaaaaaatacaaagcaggtgagagaagaataaatcacttggtgatgtggaagaaattacagctcagtggcctacaaagaggattactaataaaaatcagccaactcaccccacagaacttctgagaaattcagcactagagtgcatcaggtgctatgggaggtgggggtatggcatagagaaaaaaatcaagttgaaagtttatatacagaccactgagaacaacaggtgttaccccaactatgtgcagccaaatgaccattcccgcataacccatccctctaactttctactctacctgcagaagacctcagttctggagaaagctaactaagggcacaagtctaggaactactttgcacagtagtgggctgaggagaggtgtgggctgaaaagcaatgagattaaataaagtctccagactgaaaccagccaccttccctgttcctgctctcacaactccagcagctagtcttatgcaccctccaccccacaaaaaaaccctaactctgctaccccagacaggacttcagaggattcctctttgggaaaactgaatagttgcaaaggaaaataaaacctgcagatgatgacatttgtaaatgcccccgacccaaagaaagaggccagcccactgcctgattccctgtacagtgaaaatgatccaccaacaagccctgcccatgcacggagtctccagtcaatatgttagtgcttcatttaaaatttttttttattattattattttttttacagatggctgtcacccaagctggagtacagtggcacaatcatagctcactgcagcctcaaactcctagactcaagcaatccttctgcctcagcctcctgagtagctgggactataggcaagtaccatcacaccgggctaaattcctttttttgtagagacgaggtctcactatgttgtccaggctggtcttgaactcctggcctcaagcaatcctcccacctcagcctcccaaaatgctgggattatgggtgtgagtcattgtgccaggccatgtctcactcttaaatagaaacagcaaggattaccatacatataagaaaatcatatggaagaaatcctcccaaaacaaacaattaaaaaaaaataccaggaagacaaagagactatgcttggaacaaatagaaactgaaaatatatatgtataatcagagatgtaataaaggatactgtggtgataaaataaaaataggatgcctcaaagaaacaaccagagaccagataaaaatgtataaaaatgtaataaataaaagttaaaactcaatagaggagctggaagataaaaacaaggaaatgtcccagaaaaagtaagagaaagtaagtaaaaatgatgggaaaaacaatagaaaataaaatatgcataacttaatcaatcaagaaaatccaacatccaataaacatccaaaacaagaggacagagaaaacagaggtagaatttggaaaagttgttcaggaacaccctctagaactaaagacactagtttccatattgaaagggcctaccaagtgctcagcataatgaatttaaaaagacgcatgtccagacatagcatcataaaatttcaaaacgctcaggataaaaagaagacacttaatttttcttctcctttttttttttttgagacagagtcttgctctgttgcccaggttggagtgcagtggcgcgatctcgactcactgcaagctccgcctcctgggttcatgccattctcctgcctcagccttctgagtagctgggactacaggtgccagccaccatgtccggctaaccatatatatatatatatatatatatatatatatatatatatatatatatatatatatatatatatttttttttttttttttttttttttttttttagtagagacggggtttcaccgtgttttcttctccttttcttgaggcagggtcttgctctgttgcccaggctacagtgcagtgtcactatcttggctcaatgtagccttaacctcctgggctcaagtgaccctcctgcctcagccacccaagtagctaggactataggcacgtgccaccacacctggctaattttgcttattttttgtaaagatgaggtctcactacgttgcccaggctggtctcaaattcctaggctcaagagatcctcctgcttcagcctcccaaagtgctaggattacaggcttgagccactgtgcctggccagaagatattaaatatttcaggaaaaaaaaactgggttatatccatgaccataaaactgctcaatagctaccaagatactagaagacaatgaagcaatgccttcaaaattctaaaggaaaagttattcgagtctaaaattcttaatcctacccaactattaatttggtgctaaaccagaacaaagatattttttagacatggaataactcaaaatatatatctcatatacccttttttttttttttgagacggagtctcactctgtcgcccatgctggagtgcagtggcacaatcttggctcactgcaacctctgcctcccaggttcaagcaattctctgcctcagcctcccaagtagctgggattacaggtgcccaccaccacgcccagctaattttttgtttttagtagagatggggtttcaccatcttgaccaggctggtcttgaactcctgacctcgtgatctacctgccttggcctcccaaagtgctgggattacaggtgtaagccactgcgcccagccttcatacaccctttcttagacaactactgagaaagtacttcagaaaaacagaaaaaaatcaataaaaaagagaaggaactccaggagaggagggatacagaacaggagatttatgaagttaagttccagtatgacagctttataccaggcccagagaacaaccaggacagactggggtaggataaaagatgtgtgagaaaaatctccagaaaaacaataaaacctataaactatttgatgtgtttaagtgttgttaaaagaaaaaaaaaaaaagaacattgttaggtacttgacagatctagtggagcaaccagggaataaaacagtgattggcacccacaaactaagcaaaaaaccaaacaagcaataaaagacaattattaaccccaggaaaaataaaaggtagtacatggaagaaaaaagtagtcatagttactactttgcccagcagtggaataacacacacagtgttgtaaaatataggtgctgatactgattcaataaaaactatgatgttgaccaggtgtggtggttcatgcttatagtcctggcactttgggaggccaaggagggtggatcgcttaagtccaggaattcgacagcagcctgggcaacatggcaaaaccctgtctctataaaaaatacaaaaattagccaggcatgatggagggtgcttgtagtcctagctacttaggaggctgaagtgggaggatcacctgagctggggaggtcaaggcttccgtgagccatgactgccactgcactctagccctgagtgacagagtgagaccccgtctcaaaaacaaaacaagaaaaaacaaaacaaataaacaagaaaccatggtgtaactactacaggaaaatcaggcaaaggggaaaaggggatattggtaccaaagagctaaatttttttttttttttgagatggagtcttgctctgtcacccaggctggaatgcagtggcgagatctcggctcactgcaacctccacctacctggctcaaaccattcccctgcctcagcctcctgagtagctgggattacaggtgcacaccaccacacccggctaatttttttcctatttttagtagcgatggggtttcaccatgttggcaagactggtcaaactcctgatctcaggcaatccaaccgccttggcctccaagtgctgggattataggagtgagccactgcacctggccccaaagagctaaatctttatcactgtccatgatgggagtgcaacaaataatgtctaaaatttataattcaggaaatataatataaggtcttatttagaaatatggaatactagcaaaagccagaaagtagttgcttcaaagaagttgaactaggggtgggaagaaagaggaaggctgctattctaatcataagccttttagaaccttttttaattttttttaagagataaggtcttactctgtcacccaggctggagtgcagtggcatgatcacagctcactgcagcctcaaacttgcaagctcaagcaatcctcctgcctcagcctcccaagtagttgggactacaggtacatgccactgtgccaggctaatttttttatgttttgcagagacaagctcttgctatgttccccaggctggtcttaatcttctgggctcaagtgatcttcctgcctcagcttcccaaagtgctgagattacaggtatgagccaccacacctggcctagaacttttttgtaaagctatgttaacagtcactgtctgagaagttaagttttcaagatgttttaatttttttctcttgccatgactacattttctaaataatcttgtattacttgtgtaatttttaaaaatgtttttaagtgttgcattaaaaaaaaaacaaaacaaaaccacagcacaagtgttgcaaaatcttgcataaatcagggactgacctttgtactctcctttcagggccttaccttttatcgtagtcaaaatgaagaaagcaatgagggtgttgttgatggcacaggtagacttggcaacacaagacaaaatcgtgtaaggatttaagagatagctggggaagaacaaacatatttggcattagtaatcctgaccaaggagccctcgccattacagcaaggaagttccaagagatttattaaaagcttacgcaaaggaaggcagcttctcagaaatgagttcccccaaataaaagagaatagagtgggggttgaggctgataagtaaaaggtactgaacatggactgcctattctgttctatggagtatatggaaaactgttgtatttaatcatcacagagatcctgtaactcacaataacatcattccagttttgcagatgaggaaacatttgcaggtgacattcaagaagcagctgagtctcaatggtaaagcgacttgcccaaaatctcacaaactaataaatacatccaaaatcaggtctttctagctctataaatgttcattttactatttcagatttcaaaaaatgataaaattctaccaattcccacagagccacatatctcaagaatagctacatttacctctgagaaccaggaaagtacattttcctcagtcaggctcctaagccctgacacaggtcatgccaatccaagagttaaagcagcttagatgtagccttcttggcagttaaacagaatccactgagccagaccccaaggacagaataagtatctactgagctcaacaagtcaagtgttacagaacttcaaaggacatctggaccctcactaggaaggagttaataagctgaaacacctagtgttttcctgagatgggaaggaatgaactgagaaaatgaattcaaaatgtttgtgagtagggaaatcttagatagtcataacaaattgtttgtatttatttctatcctgcttccacaaaggatttgaggcagctaaaatgagaacaagccgggagcagtggctcatgcctgtaatcccagcactttgggaggccgacacaggcagatcacctgaggttgggagtttgagaccagcctgaccaacatggagaaaccctgcctctactaaaaatacaaaattggccaggcgtggtggcacatgcctgtaatcccagctactcgggagcctgaggcaggagaatggcttgaacccgggaggctgaggttgcagtgaaccgagatgacgccattgcactccagcctgggcaacaagagtgaagctcagtctcaaaaaaaaaaaagaacagataataaaaaataggctgggcatggtggctcactcacacctgtaatcccagcactttgggaggccaaggtgggtggatcacttgagctcgagttcgagaccagcctagccaacatggcgagactctgtctctactaaaaaaaaaacataaaaaaacccttagccaggcatggtagtacacacctgtagtcccagatacttgggaggctgaggtgggagaatcacttcagtccaggaggtagaggctacagtgagccgtgactgtaccactgtactccagcctgggtgacagagtgagactccatctcaaaaaaacaaagaacagataataaaaaataatagcaaagtacaaatagaaataaagaatcggccaggagcaataactcatgcctgtaatcccagcactttgggaggccgaggtgggtggatcatttgaggtcaggagttcaagaccagcctggccaacatggtgaaaccccgtctctgctaaaagtacaaaaaaatatccaggcgtggtggcgggtacctgtagtcccagctactcgggaggctgaggcaggagaattgcttgaacccaggaggtagaggttgcagtgagccgagattgcaccactgcactccagcctgggcaacagagcaagactccgtctcaaataaataaataaataatcaagagcaaggaaaacataaataaaaggagacagtaaaggcaatggaaggaccaccaaatggatattctacagcactatagtaatcagctacaaattcggctctgagtttcctggcagagaaagtgaaaaggtagactagttacataattctggttatcagataggaagaaacatgccagtgtctcaggaagagatgatgattactattcacaaataaagaccttaaatccaatacctcccacgactgtgagattagcagttctacagccaaaggcctagaaattgctggcggtttttttcagcaattacagacaggcttgttacataatctttaaagaaacagctgctgctattacaaagctacccccaggacacacataagtccataagagattcataaagttgctaaatttctggttctattaaggtagatcccaccaatatttctgaaatacatagattagaactgatagtccaaaactatttggtgggaagaaaaaaaagccatttctaaatagcaggtgacgttcaagaagcagctgcatagacatctaatagggaataggaaatccacacacaaggcagaaggttgagtaaactagtctcacaaggccccttctaattctgaagttctaagggcgtgtttttccacgaggaaacttgtttgtcttgtttactgtatatccctagaaactggtatattattaatattcaatgactattagtggattgaataattattcacatttgcctatctcaggaagataaatgggaataacccaaaagagtacaacttaatggtagcactgggtacaccctagagaattctttcatagagcctcagtaagttccagtcttccacatgggtcacccagctggaatgcatctgtttggcacttcagttttataagctacaaatggaggactatactgtacacgaaacataagagctgcttgaaatggcagccacataaaaaccaaacttttattcaatccatacatcacaattgaagaactttagaaacactggttataagtaggctggaacccagatcagcatggagtcaaaaagcatttgtgaagggtttgattgtacacagccctgtgtgagtctttgtcccaagagagacagaatggctctgtctcttttgctggccagaacaacagagcccagttgtgcaacagaactacagcaaatacttgatgactaagattgcaaatctccaaaaatacaacaaacaacatgggaaagtctcatcagattttcctcgcatttgttggcactaagcctgttttgtcagggaatacttacaacagggccactttcaaagggatgtaacgcatttccataggggtccggatgagttcggccacatctggggcatactggtccagttctaggaggagtttctgctttttaaactagaaaaaaaaaaaaaaggaaaagataaaacacatgaaacaattcacttcccattgtttttatgctgaagacaaaagtcctttccatggcccacatggccctgcctggtctggccctacctctccaggctcatctcacactcggccctccccatcccctttctgggttccagcaccatgaacatgctgtgtccctccttttcccacacctttgcatttgacctggaataatttcttcttctctttccctagttaactcccacatggtccttatatctcagttaaatcatcatttccttaggaaggcacactttccctcaccaccccacacccaggtaaaatccccctgttatatatgttctttcacatatgttcacagttagtaactttttcacttatttatatgattgactaatgtctgtctccctcattagactaagagttccatgagggcagggaccatgtttatttgcttaccatgtatgcctaacacctggcacagtggacaaacaataaatatctgttgaatggctaaatgaatgacttgctggcaaagcaaagttcatagccatttgaagagttatcatcagtggcctaaagactccaaagttccatccatgaagaagtattgtcaagcaaggtagaatgatcccaaatgtcacaggatcttgggttatgttttacttccacagaggaggcgtagaatggccatgatgatcaagaggaggaaagctgggtgtgggtgggcagctggatagttaatagggagtgggatgggggtggaaagctcttgccttccgctggtgtgtcctaacaagttcatgggtgtgttccagagtgaaagaaaggtaggcaatcttataagcaaacatgggtcagaatatagatgagaaagcctctcaaaccaaaatcggtggccctgttgatttaatgatcaaagaatctcatttagacaatataaaatcaatgctgctatctattagaaaacagtatttcagaggagccaagatagctgtgcttaactgtgaaggattaaaaatttaatgatgtaaaaagcagatcacactagaaaatatactgcattgtgacatttatatgaagttaaaagcatgtaaaataatactatgtgttgggggccaggcatggtggctcatgcctgtaatcccagcactttgggaggccgaggcaggcagatcacaaggtcaggagatcgagaccatcctggctaacatggtgaaaccccgtctctactaaaaatacaaaaaactagctgggcatggtggcgggcacctgtagtcccagctactcgggaggctgaggcaggagaatggcgtgaacccgggaggcggagcttgcagtgagccgagattataccaccgcactccagcctgggcgacagagcaagactccgtctcaaaaaaaataaaaaataatactatgtgttatttagtaacatatataataaaagtcaaggccatgtgtgtggatgataaccactagattcagaacagtggtactgggtaggaggagaaatagggagatgaaagtatgagagagagagagagagctgtaggagtaaatttttttcagcccgaaaataggttcaaaagtatgtactatgctttatctatttttgcatgtcttaggtctttcaaaattaaaaaaaaattaaccaaaaaatatttttagaagaccatctttcagtttaaacttgcacaggtttaggtagaggcttaatctgaaaacctgcaacaaacttcaaaaacctccctttgatcatctctgttcttctcacagttggcagagtccaagttaagcggtgggaattatcagtaagatttatggtgccattcacagctggggttgtttaattaaaaggacaaaatataaaccaaggtgcttttatcacagagaagggggctggctcagcaatcaagtgcttagtgaggacagctgcagcagtggtagcaggaaggaggcctcactagctaagaggtctagagttctgcagcaaaaacaaggccacctggagtgggtgagatccacaaagaaggctgtgagaaaggaatagagttcatccaggggcagccagacagacaggtgggaatgcagacctcattccccaggctggaagccagccagcagggctgcactgagagaaagtggcaactacccgggatgtgtacatcctgggcaaaggtgacactgtgccagcaatggaagtacttccttataaccacaatcttctcaaatactttaaaacagaaagatcttctgaaaggagtctccaggtgggaaggcacacagatcagcaatccccacattctcagctttctagtctccctcaatttcagcagcacaggcactattatggctctcctcataggcccaatatcagctctcctaagtgtagacaaaatcccttttaaaaatccctattgcatccagctagagacaggaaagtggctaaaatcaatggaaatttttaaaattatacacacatgtgcgcacgcgcacacacacacacacacacacacacacacacacacaccccttaagaaaatataagtataaaatgaagttagggtatatattaaaatctgatgatcaatatttctagatacattcattagtcttgacaatgataagatttaaaacaatgacaggagagattaaaagtgatgtgaagggtagtgacctggatatcttacctttgtgatcactaatcagcttgtagacagatggtatgcttttccatatgtaagttatattaaaaaatcaaaatgttttaatttttaaaaatctccagggtagagtcttcctttccttccacccactcctctatacagccctttccttgtcccttgaaagataggttttgccaggacataattcccctacttcaaataaagggctttattttcttggagacagagtcttgctctgtcaccaggatggagtgcagtgttgcgatctcagctcaatgcaacctccgcctcccgggttcaagtgattctcttgcctcagcctcccaagtagctgggattacaggcgcccaccaccgcgcccggctaatttttatatttttagtagagacgggctttcaccacgttgaaactcctgaccaggctggagtttcaccaggctggtcttgaactcctgacctcgtgatctgcctgcctcagcctcccaaagtgttgggattacaggcgtgagccacagcgcccggctataaagggctttttctaatcattgaagctgcatctacgttcatttgcatccccaaaaactatggtggggtcggggagaggaaacactccacccctgtccctactcctctccaactgttagcctcagcacattccaaattcaggagcctagcctccaaatttacaaccctctaatcatattaaggggacacaggtttttatcatccattatcaaaccacctgcagctctcttaacataaattctgagttccaaacaagaagcaccatctcagcaaaggacagactagactaacattgtttttgtcaagtgagatagatgtaaaatgtcatgataaccaactggtcaccatcagcattcagtccgcaggctaacagctggagagggggtgggggtgcagtcccctctctgccctatagttctcccagatgcatctgtgtgtagacatagtttcattaccaaggataaaaagactcaaatcccaccaagatttaaatacttcccagactatgcgatatgaacccttctgacaaagggaagaagatttagaggaagacatgctgctatcctacctaaatcaacagtagtatgttagtatcatcaaaatctgccatttaaaatgagttaatttttgacagagcatacataaaacttctattctgatgaagaaacctaatgttctaatagtctgaactctaaaagtggaaaaacaaaaacattccaaattttacttcagtcttggtaataacagaatgtcttggtgcactaaaaaccagggtattgacaacaccgtttggctttctctctccctctttaaatcatgcaaagaaaaaaacccaaaaatctctatatatttccaaataaactcagcaataacaaacaaattattggtgctctaaattaaaggcatctctcctgttgacattgaagcctgactttgttaggcaattaactgaaacctagtttcattgcttcctcataaactaaccctaccattaaaaactgttttgttttgagacagtgtttcactctgtcactcaggcgggagtgcagtggcatgaccacagctcactgcagccttgacctcccatgctcaagccatccacctgtctcagtctccagagtagctgggcctacaggcacataccaccactcctggctaattttttaaagaattttttgtagagacagggtcccactatattgcccaggctggtcttaagcaaaaaattgttttaactagggagtgtgagaggttttttgatgagaattgagcaggaaaaaaaaaatacatatggcattagcatctaatcaactttcattaaaacacagttcagttttacattttggttataaagatctgggtaattgtggtcttagatgaaagctaccaatcctgcctcagctattcatatctatatcacacatatatatatctcatatatatatatatatatatatatgcacacacacatatctcatatatatatatatatatatgcacacacacaagtttattttttccctagtcttttttttttttttttttttggagattcactttcaaaaagtttcactctgttgcccaggctggagtacagtggcgcgatcttggctcactccaatctccaccacctgggttcaattgattcttatgcctcagcctcccaagtaggtgggattacaggtgcacaccatcacacttggctaatttttgtattattggtagagactgtctacctacccaacctatttcggagaagagaacagtcactgctaatttatatctgaattcctcagcttatgaaacccatgcccaattatttcatctacggccctcaagagaatcctgttaaagcatttcatctcagcccctaaagttttcaagatatgctccattagtttaagatatatactccctggtcttggtgatactaagtccctaaaatatagttcttaattttagaggaagagtcaaagaccacacaccaataacagctatgaactcttggaaacaatgatatacacacacacacatataattctccataccatttccacagttttataggcccattaaggccaagttaagaaccctcagtctagatattttttaaaatctctctggggtctaaaattctagaattcaccagcttcatctgtcactgatgaccagtgacacagaaagcacactgctatttctggtttcattagtaacaaaagctaaaatgaaccacaaacagacaatgccaatgagatgcagccttatttcaccccagcctaaatcttctctctcagtggctcccagccaatcaaggagtgttgtagccatttaactacatgggtagtacacatggttaatctgttaactttctcagaccccaggaaaagaagaatggtcccactatgcaattctccttggctattacatatggattaagactgaagtttatatcaggcatttaatacatgtcaaattttccaattaagattactttctgcagggagacagaaatgacattgagaatccaattttacctcagataggcataacagtgacttaaaagctgtatttatcttcctatgcaaaaaaaaaaaaaaaaaaaaaagactggtgaaagactagaagatttttaagggtcctcattaacgacaggtaatataactgttattcagcactactccagaagtctgaacttgcacaggtatgtggatattaatagttattaataagctacatagatgaagctggcccttctttatctgttagtaaagctgtcttgtgggtttggggttgatcattccagagctggctgaacaggccagaagtttcaccatcacttcctagcactttaaagcatctggatccttaagtataagatctttgtaataacaaagaccagaaggttaccaaattccaccagctttgctccacccacaaactacttaccacaactttattgaagtcctggattgcaaaatacagggcaatagcagtgagtgcatcagttatctgtcaaaagaaagagaaataataggaaatggaacacagtaagtgtaagagtactagagtgctaccagggcttggagttttgagatagtgatggactaccaagtactggactcttacaatcaggtagaacttcaaccctcactttgactacccaaagataaggcccattcaggcagggtgaactggaaatccctgaggatcaggacccatctaggttcacttcagtttagtggcccatatctgctctagaattgcaagatacttatgttttttgtaaaatggaaataatacccactgctttgcatgcctgatgtatgtcaagtgcctagcacacagtaggtcctcaataaatagagtttgttataattactaaggaagacctcagtgggcttcctgggtatttcttgactcaaattttcaatcccagacaagtgtttcaaattgctatgctctcaaaacatagacctgtcatcccaattctgaagcttctcgcccctgaaagcctcaaacctgtgtcctcttcttccataatgactcacagaatctcttggcaaaatgcttaggacaaattcagaatgccctccacgccggcttcacaattaaagccaatcatagaatctcagagctagaaaattcaagactatatatagtccagaaaccaaattctaaaaagagtaagtatttggaactggttacacatcagaaactattcctcacacttccataatactgccacagttccatgaattcaaagtaaagacataagtttttgcttttattttctgagaaactcctgagttcctatgttttttgttttttgtttttttcttaaacacaagatgacaagccgggcactgtgtcatgtgtccatagtcccagcagctgaggaggctgaaatgggaggaccacttaagtccaggagtccaagaccagcctgggcaacacagtgagaccccatctcaaaaaaaaaaaaaaaagagagagagagacaataaaccataaaatttaaaaatatatacatatcaattttatatggaaggttacttaccataaacaccaattcagcatagtcaattaggaaatgaaagaggtatattattaatggagtctgcagaaaaaaaacagacatgtaaaaaaaattaagttaaaccttactattatcagtttccagagtagagagtggggagaaaactattatgtcagcaaactattatgctagtattctccttcctggaatactgttctacgccagctggccggtgtgcttataggggagaataatttagtactgccggaccattttgtgctgctgggactatctgttgaattgagtaaaggaaataaaatctgatgtgttaaataaccattaaagaatagtcaacacactggccaggtgcggtggctcacgcctgtaatcccagcactttgggaggctgaggcaggcagatcaccaggtcaggagatggagaccatcctggctaacacggtaaaacccccgtctctactaaaaatacaaaaaaattagccgggcgtggtggcgggcgcctgtagtcccaactactagggaggctgaggcagaagaatggcgtgaacccaggaggcagagcttgtagtgagccgagatcacgcgactgcactccagcgtgggcaacagagcgagactctgtctcaaaaaaaataaataaataaataaaaaatatatagtcaagacactaaaggtaagaggtgaattgtagttctaagacatatataatagccgaggggaattccacaacagaccaagattgctgattccatttcactcacaaaatgagcttcttctgttctctgataagtttgtataatatttttttctttatttattttcttgagactagttcagaaagattaatgttatttcttcctcaaagatttgggaaaattcactcactgtgaagccatctctgcctggattttctttgagagattttaaatcacagattctatttatttcatagataaaacattcagatttgctgtttttactttgtcaatttaggtaagttgtgtttttccaggaatttgtccatttcatctaaattttcaagcttactgacaaaattgttcatagtatttcattttttattgtttaaagcaataaagtttcctatgagtatggctttagctgtatcacacgagttttgatacgttggatttttttgagatggagtctcgctctgtcacccaggctggagtgcagtggtacgatcttggctcagagcaacctccgcctcctgggttcaagtgattctcctgcctcagcctcccaagtagctgggattacaggcgcctgccaccacgcccagctaatttttgtatttttagtagagactgggtttcaccatgttggccaggctggtctggaactcctaacctcaagtgatccacctggctcagactcccgaactgctggcattacaggcaggagccactgtgcccagccattttcttcaatatcatttagttgaaaatatattctaacttccagtaacatttcttctttgagactactttaaaatgtaccatgttcaatttccaaatacttaggagttttcttttcttttcttttttttttgagacagactctcgcactgttgccagggctggtgtgcagtggctggatctcgcttgctgcaagatcctccacctccagggttcagatgattctcctgcctcagcctccccagtagctaggattacaggtgcctgccaccacacccagctaattttttttgttatttatatatttattttgaggcagagtttcgctcttgttgctcatgctggagtgcaatggcacgatctcagctcatcgcaacctccgcctcccgggttcaagcgattctcctgcctcagccaccacgctgggctaattttgtatttttagtagagatggggtttctccatgttggtcaggctagtcttgaactctcaacctcaggtgatccacccacctcggcctcccaaagtgctgagattacaagtgtgagccaccgtgcccggccgttttttgtttgtttgagacagagtcttgctctgttgctagagtgcagtggcacaatctcggctcactgtaacctccacctcccgggttcaagcgattctcctgcctcagcctcccaagtagctgggattacagccgcgcgccaccacacctggctaatttttgtatttttagtacagacggggtttcaccatctcggccaggctggtctcaaactcctgactttgtgatccacccgcctcggcctcccaaagtgctgggattacaagcgtgagccaccatgcccggcctaatttttttttgtattttttgtattttttgtatttttagtttcactatgttggccaggctggtctcgatctcctgacctcatgatctgcctgcctcggcctcccattctttttatatttttataatttctttctggcttaactctactgtggtaatagaaaatacactatatgactgcaatcatttaaaatgtgttgtgacttgcttaacggtccattatatggtcaactttggtaagtgctgcaggtacattcaaatatgcatattaacacctatggttgcatcattctatatatgacatgtaggctcagtttgctaatgatttgttcaaatcttctacatccttattgatttttttggtctgtttgttctttcactgactgaaagaggtatgttaaaaatctcccagtcaggcacagtggctcatgcctataatctcagcactttgtggggctgaggtgggaggatcacttaagcctaggcatttgagaacagcctggacaacatagtggaaccctgcctctacaaaatatttaaaaaattagctgggtgaggtagcatgcacctgtaatccaagctacttgggaggctgagttgggagaattgcttgagcccagggagattgaggctgcagtgagccttgtttgtaccaccgcactccagcctgggcaacaaagtgagaccctgtctcaaaaaaaaaaaaaaaaaaaaaatcccccactgtgactgccatttttgctttatatattttggagctatgtaattagatgcagttctatgtagaattactatatcttctgggtgcagtgatctttttatcattataaaataatcctcttcatctctagtaaggtttcttgtcttaaaatattcttgatctgatagtatagttacatcagcctctttgggctgtcagcataatacagttttttctgtcattttactttccacctttctgtgtccttatatgcaaaattttttgtttttgtttttggggttttttcctgaaacaaagtctcactctgtcggccaggcaggagtgcagtggcacgatcatgactcactgaagccttgacctcccagactcaggtgacccccctaccttaccctcctgagtaggtgagactacagatgtgcgccaccacacccagataatttttgtattttttgtagagacagagttttgccatgttgcccaagctggtcttgaactcctgggctcaagcaatccgcctgcctcagcctctcaaagtgttaggattacaggcatgagccactgcacctgacctaagatgtgactgattgattgactgattgactgatttagagatggagtctcactctgtccccaggctggagtgcagtggcgcgatctcagctcactgcaacctccgcctcctgggttcaagtaattctcctgcctcagcctcccgagtagctgggactacaggcacgtgccaccacacccagctaattttttatatttttagtagagatggggtttcactgtcttagccaggatggtctcaaactcctgacctcgtgatccgcccgccttggcctcccgaagtgctgggattacaggtgtgagccaccacgcccggtctgttttattttgaacttatgttcaaaattacatatgtttttctttgaccttctcctacttgggtttatagagcttcctgaataaaaatcttagtaaatgttgaaaaaaatttcatccataatctcctcaaatactgattctgcctcgttctgtctcttctcccattctagaactccactgatgtataatttgggctgttttactaagtttcagatctcttactttttttttttttttctgtgttttctatccttttctctccaagtttgaatctaggtattttcaacagactttatcttccatattactaatcttctctttagctttgtgtaatctgctgctaaattcatctatacatttttttttttttttgagacggagtctcgctctgtcacccaggttgaagtgcagtggcgtgatctcggctcactgcaacttccgcctcccaggttcaagtgcccaggttcaagcgattctcccacctcagcctcccgagtagctgggattacaggcgtatgccaccacgcctgcctaatttttatatttttagtagaaacagggtttcaccatgttggctaggctggtcttgaactcctgaccttaagtgatctgcccaccttggcctcccaaagtgttggtattacaggcatgagccactgtgcccggtccatctattacattcttttttttttttttttttgagacggagtctcactctgtcacccaggctggagtgcagtggcgcgatctcggctcactgcaagctccgcctcccaggttcacgccattctcctgcctcagcctcccaagtagcagggactacaggcgcccgccaccatgcctggctacttttttgtatttttggtagagacagggtttcaccgtgttggccaggatggtctcaatctcttgacctcgtgatccgcccgcctcggcctcccaaagtgctgggattacaggcatgagccaccgtgcctggccttacatttttaatttattatgttttctatttctagaatttccgtttgattcattttttacataccctggtgaaattattctgttatttatttcttgaacatattaatcattgatcatagctatttttcttttttgggaggggggaaagggtctcactttgtcacccaggctggagggcaacggcacaatctcagctcactgcaacctccaactcctgggctcaagcgatccttccacctcagcctcccaagtagctggaactacaggcacacaccaccacacccagctagtttttgtatttttggtagatacagggtttcaccatgttggccaggctggttgaattcctggcctcaagtgatctgcccatcttggccttccaaagtgctgggattacaagcgtgagccactgcatccggctgatcacagctattttaaagtccaagtagtttgataacttcaatatctaaatcacctgtaaatctgtttttattgtctatttttttctgtctcttattatgcttggtaatttttttccttttctttttttctctttttttttttttttttttttttttttttttgagaaggagtctcattctgtcatccagtcgggaatgcggtggcgtgatcttggctcactgcaacctctgtctcccaggatcaagtgattctcctgcctcagcctcccgagtagctgggactacaggcatgcaccaccatgcctggctaatttttgtatttttagtagagacagcgtttcactatgttgcttaggttggttttgaactcctgacctcaggtgatccgccagcctcggcctcccaaagtgctgggattacagatgtgagccaccatgcccagccaatggttggtaattttttattgaatgacagacattgtgtatgacaaactacagcagcttggatgaaggtattttcttctggaaaagatttctttaagctggtaattacaatatagttgtttcactttagggattgagctaatttgaagctggatttagtctttgtaaaactagtctatattggtctacccttactcctagagtgtagtccttcagaagttccagcctaaaggcaagtcctttaccagagccttgtcattttggttggtcctgcactccaatttgtatttccccagcaccctgagactgccaatagctctgcttagcttcttggtctctagccagccaatttctgttctgcttctccacctgtgtcacttacaaattggtaaatgcttcaaggacaaagcagctcagactgttcgtattactttttgtactttcccctctgggatcttaatccctggagtcctgcttatcttggtactttccaatgccttccagcagatgtggttttttttttccttttttcatattcatcctgcttttctagttgttcgtggcaggtaggttggtctgctactgcaagcccgttcaccaatccaccagaaccagaagggaagtgcatgacctggttttagcgagcccatgctgatgactgaggagcacctcttcccatcactaaaccatatgcatgaatgtgtcctataacattgagaggttattgacagactttttagtgagaacaagttagcatggtagcaagaacaaagactttggagtcagattcgcatttaaatccaggttccagacagctccggtggctcacacctgcaatcacaacactttaggaggccgaggtgggaggatcacttgaggccaggaggttgagaccatcccgggcaacaaagtgagaccccccccatctctacaaaaaaaaaattagctgggcatgggtagcatctgtagtcccagctatttggtttgtttttattttcgttttttgagtcatgattttactctgttgcctaggctggggtgcagaggtataatcatggctcactgcagcttagaccttccaggatcaagcgatcctcctacctcagcctcctgagtaactacaactacaggcacataccaccacaaccagctaatttatttttccccctggggggagaaacagagtctcactatgttgcccaggctggtcttaaactcctaggctcaagcaatactcccaccttggcctcccaaagtgctaggattacagacatgagccaccgtgcctggcctcagtttgacaaattttgacctatgtatacatccataaaaccattacagtcaagaaagtgaacatatccatcattcccaagtttatcaattttaatgctcatcccaaggaaccatctttgtttcagtgattttcactattagttttgttttctaccctttgtttctactcagatctttattatttcttttaatctgcttactttgagtataattttatcttttcctagtttcttaaggtagaagctgtggttattgacttgaggtcttcttttctaatataagcatttggtgctataagtctctccctaagaactacttagtgacatcccacatattttgatgggttgtgtttcattttcattcatttcaaaatactttctaatttcctttctgatttcttctttgatccatgggttaattaagaatatgttactcagtttctaaatatttggggattctctagatatctttctggtattttttatttaattcaattgtggtcagagaatatattttgtataacttgaatccttctaaacttactgagccttgttttatagaccagaatgtggtctatcttgcaaatgttccgtgtacatttgaaaaaaattatgtgttttgctgttgttggatggagtgttctataaatgacaactaggtcaagttgggttttttttttttttttgagatgaagtctaggtttgtcgcccaggttggagtgcagtggcactatctccgctcactgcaagctccgcctcccaggttcaagccattctcctgcctcagcctcccaagtagctgggattacaggtgcacaacaccacacccagctaatttttctatttttagcagagacggggtttcaccatgttggtcaggctggtctcaaactcctggcctcaatctacccgccttggcctcccaaagtgctgggattacaggcgtgagccaccatgtctgacccaagttggttgttattcaagtcttttatatctttgctgattttatgtctgcttgttctaccaatcattgagaaagggatattgaaatctctgtaattgtggatctatttctccttgtagttctatcagtcttcatatattttgaagctctgtaatttgatacataagcatttagtatcgctatctcttttatcattatgaaatgtattttatctctggtgatacccttggctctgaaatttgtttcttttttttactaacttattgtctgtttctctcagaagtataagcaccatgaagccaggcactgtgtcttgttttgtatccctaacacctagcagagtagctggcacttagtgaatatttaacaaatctttactaaaggaaggacagaagggagggaaggattgtaatgcatatgctgatagaggtaggcactaggaataagtgataagaaggggacagcacctgttttgaagacaatatatcataatgagtaaaataaacacagaggcaatttcaagagtgtgacatgagccaggaaaaggataagcataagattctttggaagactaaggtgatgagagacacctttcttttttttttttgagacggagtctcgctctgtcacccaggctggagtgcagtggcaccatctcggctcactgcaagctccgcctcccgtgttcacgccattctcctgcctcagcctcctgagtagctgggactacagccacctgccaccatgccttgctaattttttgtatttttagtagagacggggtttcgccatattggccaggctggtctcgaactcccgaccttgtgatccgcccgcctaggcttcccaaagtgctgggattacaggcgtgagccaccgtgcccggccctgtgtgcttattaagagtctcttggccgggcacggtggctcacgcctgtaatcctagcactttgggaggccgaggcaggtggatcacctgaggtcaggagttcgagagcagcctggccaaggtggcaaaaccctgtctctactaaaaattcaaaaattagccaggcgtggtggcacacgcctataactccagctacttgggatgctgaggcaggacaatcacttgaatccagggtgggggaagggggagggggttgcagaggttgcaatgagccgagttggcgccacttcactccacctgggcaaaagagcaaaactctgtctcaaaaaaaaaaaaaaaaaagtctctgaagttgttcctaacctgtttctgccagtagttcttgttattgcagtttgattagatattaacccagagataataaaattgaaatgcaaaagacagctgttatttctatgaggaccaagttgaatgcttttgaaagattagacagaagagccaaaaaacaaacaaaaaaaaactgttctcaaagtacatatgagagagataactataaaaattaaggccagccaggaacggtgactcacagctgtaatcccagcactttgggaggccgaggcaggcggatcacaaggtcaggagttcgagaccagcctggccaatatggtgaaaccccgtctccactaaaaatacaaaaattagccaggcatggtggcgcgtgcctgtggtcccagcttctcgggaggctgaggcagaggagtcgcttgaacccgggaggcagaggttgcagtgagctgagattgcaccattgcactccatcctgggcgacagagcgagactctgtctcaaaaaaaaaaaaaaaattaaggccaagcacagtggctcatgcctgtaatcccaacactttcggaggccaaggcaggaggattacttgagtgcaggagttcaagaccagcctgggcaacatagcaagaccccatctctacaaagaaatttttaaaaattagccagctgtggtggtacatgtctgtagtcctagctactcaggaggctgaggtgggaggactgcttgagcccaggaggttgaggctatagtaagccatgatcattccaccacattccagcctcggtgacagagcaagaccctgtctttaaaaaaaaaaaattagaaggtacattgtcaaattagaaaacttctttaaaatgatatggccaataagaacggaaagggcagtgggacgcggtggctcacgcctgtaatcccagcactttgggaggccaaggcaggcggatcacgaagtcaggagtttgagagcatcctggctaatatgatgaaaccccgtctctactaaaaacacaaaaaaaaattagccaggcatagtcacgggcacctgtggtcccagctactccggaggctgaggcaggagaatggcgtgaacccaggaggcagagcttgcagtgagccaagatcgtgccactgcattccagcctgggtgacagagcaagactctgtctcaaaaaaataaaaaagaatggaaagggcagtggaaagaaatgtgatggatgtggtgaggagggtcttcagggctttgtatgcccctctaaggtatctggattttatcctgaggtgaatggtgaacattcaaaggtgccgagcaagacggtgacagaaacagattcacattttagaaagatggctctgactacagaatacagtgaatgagcaagactgaatgcaaaaagacctgtcaggaagctgttgctgtaaacaagagataatctggacctaattaagagtgttttcactattctttttttttttttttttttttttgagatggagtctcgccctgtggcccaggctggagtgcaatggtgcagtctcggctcactgcaaactctgcctcccgggttcaaacaattgtcctgcctcagcctcccaagtagctgggattacaggcacctgccaccatgcccagctattttttgtatgtttagtagagctgggggtttaccacgttggccaggctggtcttgaactcctgacctcgtgatccacttgcgttggcctcccaaagtgctgggattacaggtgtaagccaccgcgcctggcctgtttataattttttttttttttttttttgagacggagtctcgctctgtcacccaggctggagtgcagtggtgcgatctcggctcactgcaagctccacctcccgggttcgcgccattctcctgcctcagcctcccgagtagctgggactacaggcgcccactaccgcgcccagctaatcttttgtattttcagtagagacggggtttcaccgtgttagccaggatggtttcgatttcctgacctcgtgatccgcccacttcggcctcccaaagtgctgggattacaggtatgagccactgcacccggcctgtttttactattcttaagagctaattttaaataaaaattagctgggcatggtggtgcacacttgtggtccctactaaggaggctcaagtaggaggatcgcttgagcccaggaggtcaaggctgcagtgaaccgtgattgtgtcactgcactctagcctgggtgacagaataagaccctgccaaaaaaaaaaaaaaaagctaattttatgggttaagtaagtttttctgggctttctaaggaaacaacattactgccgtagttttcatgggaaatcatattccaaacaacaaattacatgctaattagcatacaacctatttgcggactaaggactgtttgcaacttatttgcctttacaaatggtaacttctacagaagcctcatctgcttccccagttacaatcttaatctggatcatttccattgcaattgcaaaacctctttcttatgcagaggacatctaaaaacgggctgtttctaaatatgatcgtcaagaatacatctttttaaatgtttgtacaaaacagaggttaggctttggtatctgtgactgtaaactactcttggtacccagaaaagaaaataagaacacttacttcatgaaatactgctccagaatacggagatactcccaagtccaacagtgaaaggccttcaaccactgaaaaattagatatacaagttcactcagactaagcaggcagctacagaccaaattgttagatacccccacaaccaaaaagggccttagcgtttatctaaccccctttacctcatccccagcaagtggctttaagtcttgaacatttctgatgacgggaaactctctttcatggacagcatcctttttcattgtgggcagcactcattataagacagttttatgttaaactatctgcttccttttagttccttgtaactcttaccaactctcaaaaatgtctcatttatgcctaatcttccccattccaaagcacaataagataacaaattagaagctggtgagaaatgttgccatagtgtgaggaaatgggcagtcactctcatatgctgctcatttgagtgacatttgtattaacttttcgacagggcaatatgtgctttctaagtgtgtgccttctgacccagatatgatacttcttagggcagtttatcctatggaaataacctgacaagtacccaaagaggtatgttccttacactgttcagagtactgaacaattagaaataatctgaatgtccattaatgaaaatttatttcaatgaattatgacataatatatatctctatataatggaatgctttatacttaaaattatactgtgttataaataataaataacctctccctctccctctccctcaccctctccctctctctctctccacggtctccctctccctctctttccacggtctccctctccctctctttccacggtctccctctgatgccgagccgaagctggactgtactgctgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggccggtctccagctcctaaccgcgagtgatccgccaacctcggcctcccgaggtgccgggattgcagacggagtctcgttcactcagtgctcagtggtgcccaggctggagtgcagtggcgtgatctcggctcgctacaacctccacctcccagccacctgccttggcctcccaaagtgccgagattgcagcctctgcccggccgccaccccgtctgggaagtgaggagcatctctgcctggccgcccatcatctgggatgtgaggagcccctctgcctggctgcccagtctggaaagtgaggagcctctctgcccagccgccatcccatctaggaagtgaggagcgtctctgcccggccgcccatcgtctgagatgtgggcagtgcctctgccccaccgccccgtctgggatgtgaggagcgcctctgcccagccgcgaccccatctgggaggtgaggagcgtctctgcccagccgccccgtctgagaagtgaggagaccctctgcctgacaaccgccccgtctgagaagtgaggagcccctccgcccggcagccgccccgtctgagaagtgaggagcccctccgcctggcagccgccccgtctgagaagcgaggagcccctccgcccggcagccaccccgtctgggaagtgaggagcatctccgcccggcagccaccccgtccaggagggaggtgggggtcaacccccgccaggccagccgccccgtccgggagggaggcggaggggtcagccccccgcccagccagccgccccgtccgggaggtgaggggcgcctctgcccggccaccccctactgggaagtgaggagcccctctgcccggccagctgccccgtccgggagggaggtgggggggtcagccccccacccggccagccgccccgtccgggaggtgaggggcgcctctgcccggctgcccctactgggaagtgaggagcccctctgcccggccagccgccccgtccaggagggaggtgggggggtcagccccccgcccggccagccgccccgtccgggagggaggtgggggggtcagccccccgcccggccagccaccccgtccgggagggaggtgggggggtcagccccccgcccggccagccgccccgtccgggaggtgaggggcgcctctgcccggccgcccctactgggaagtgaggagcccctctgcccggccagccgcccggtccgggagggaggtgggggggtcagcccccggcccggccagccgccccgtccgggaggtgaggggcgcctctgcccggctgcccctactgggaagtgaggagcccctctgcccagccaccacccagtcttggaggtgtacccaacagctcattgagaacgggccaggatgacaatggcggttttgtggaatagaaaggggggaaaggtggggaaaagattgagaaatcggatggtggccgtgtctgtatagaaagaagtagacatgggagacttttcattttgttctgtactaagaaaaattattctgccttgggatcctgttgatctgtgaccttacccccaaccccatgctctctgaaacatgtgctgtgtccactcagggttaaatggattaagggcggtgcaagatgtgctttgttaaacagatgcttgaaggcagcatgcttgttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaagaacagctttaaaaaataaataaataataaataaataagtggaagagaaaggagagcttttccctacagagaattctaaggatcaaatgtagaaggaacaaagaaatagaaaatcaccacttggcgtactccatccatagtaataatcacaaaaggcaagaatcatcaatggatgctaaaattagtgggcaaaaatatgagaaacagaatatttgcaaggggaaaaataaaattttacatgggcggtggttcatgcctgtaatcccagcactttgggaggccaaggcaggtggatcacctgaggtcaggcgttcaagaccagcctggccaacatggcaaaaccctgtctccattaaaaatacaaaaattagccaggcatggtggcgcgcacctgtaatcccagctacttgggagagtgaggcaggagaatcgcttgaacctgggaggcggaggttgcaatgagccaagattgtgccactgcactccagcctgggcaacagagtgaaactccttctcaaaaagcaaacaaacaaaaaagcataacctcagtctaactgtgagaagacatcaggcagacccaaatggagacataaaataactggcaagtactcttaaaaatattaagcctatgtacaactactaggtatccataaaaattaaatttaaaaaattgtaaatgttaagtctgaggaagtatcccagattataagagactaaggcgacaaaacaactaagtgcaaagtggaatcacaggttggatattggactagaaatggacattagtggggcaaattgataaaattctaataaggcctgtaattagttaatagcattgtatcaatgttaattttctggtttaggtcattgcactatggtgatgtagaatgttaacattagaaaaaggtgaatgaaaggtaaacaggaactcttgtaacttttttgaaaatctaaaattattttaaaattaagagttaaaattaaaaagtacactagagatctatatttaatgaagaaaagcagcccataaaatattcttaaatgaaaagtaggtcaaaagacagcatataaaatataataggtttttttggtgatttttttaaatgactattttagcaatttctcttggcttttacttattttcctttgcaaattttctgggggttgagggggtacatgtccaggtttgttacatgggtaaattgcatgtcatagaggtttggagtgcagataatctcatcacccaggtaataagcacagtacccgacaggtagcttttccatcttcaccctcctcccaccctccaccctcaagtaggcccaggtatctactgctactttctttgtgtccatgtgtactcagtgtttagcttccacttataagtgagaatatgctgtatttggttttctgttcttgcattaatttgcttaggataatgtctccagctccatccatgttggtgcaaaggacatgagctcattctttttttttttttaatgctgcatagtgttccatggtgtatatgtacattttctttatccagtccaccactgatgggcattcaggttaattccatgtctttgctattgtgaatactgctgtgatgaacatacacatgcatgcatctttagggcagaacaatttctattcctttaggtatatacctagtaatgggattgatgggtcgaatggcagttctgttttaggatctttgagaaatcttcaaactgctttccacggtggctgaattaatttatattcccaccagtcgtgtataagtgtttccttttctccacaaccttgccagcatctattattttttgactttttaataatggtcattctgactggtatgagatagtatctcattgtggttttgagatagtatctcattgtggttttgatttgcatttctctaatgactaattatgttgagcattttttcatatgcttgttggccacatgcatgtcttcttttgagatgtgtctgttcatgtcctgtgcccccccgccaactgtttttccaagacaggttctcgctctattgcccaggttgaagtacagtggcatgatcagggctcactgcagccttgacctctcaggctcaatcgatcctcccacctcagcctctcgagcagttgggacttcaggtgtgcatcaccatgcctggctaatttttgtattttttgtagagatggggtttcaccatgttactcaggctggtctcaaactcctgggctcaagcaatcttcctgcctcagcctcccaaagtgctggaattacagtggtgctggaattacaggtatgagccaccatgcccagccctttgcctttttttttttttttttgagacagagtctcggtctgtcacccaggctggaatgcagtggcttgatcttggctcactgcaacctctgcctcctgggttcaagcaattctcctgcctcagccacccagtagctaggattacaggtgcctgccaccagaccacctaatttttgtatttttagtggagtcggggttttactatgttggccaggctagtcttgaactcctgacctcaagggatctgcctgcctcagcttttcaaaattgcacatttttaaataggtttgtttgtagagttttatcttaaacttttataagcattcatttaattatttgaaagagagagaatgaacatgtactcaatgagaaatgcctggaaaaataaatatttaaatgttcacaatgaccatttctaggtgataagattacagaagatgcttgatttttttcatcttcattttatgaatctttagcaatgaggatgtattattttacaattattcaaaagaagtagtttttgtttttgttttggagacagggtctcgctctgtcatccagactggagtacaggaattacaaacgtggctcactgcagcctcaacctcctgggcacaagcgatcatcccacctcagcctcccaagtagctgagaacacaggccaatgccactacacccagctaaatttttttttggtagagacagtgtcttgccatgttgcgcaggctggtcttgaactcctgggctcaagccatcttcccaccttgacctcccaaagtggtgggattacaggcgtgagccactgcacctagctactttttatttttgaatcatgtgactgagttacctattaaaaaataggtaggcagggattcaaggagttcaagatcagcctgggcaacataaggagaccctgtctctataaaaaaacaaaaattagctggggcatggtgatgtgtgcctgtggtcccagctacttgggaggctgaagtgggaagatcaattgagcccaggaggtcaaagctgcagcgagtcatgatcatgctactgcactccagcctgggtgacagagggaaaccctgtatcaaataaacaaaaacagaaagaaaagaaaagaaaaaagaccactacatatttgtaaggagtgggctataattatgactttaaactttataagactaccctaaagaaggtagggtagtcctataatcaattttataattcatggtggccataaaataaaacaaagcatattgctcaagaccgttgtaactggtccttatactgcaaccaaaaggaaatctcaaggagctgcataaagaggttgctgcgtaatagctattaaatccttcactaacagctttactggagacccaaggagataattcatcaggtcaaatcacaaggcatttctcaatcttagccaatggcatcctaccacagagcagtaaaaaagcaactctacagggcaccagtatgcggccgtccaggcacatcactctccacttgtctggtttaatccagatggaaatttttgagacacagcttgaggacagactgcacaacttttaggcaattgcctaaaatgtaattcatctcagatatgcttttgctagatactgtatatcagtggatttgttagtgtattctctggcaaatgcctggagtgtggctctgctatattgatgattaaatatggcatcatattacttaattgataactgatctgggcaaagggtcagactatgtaaaacatgtaaaacatttttttgtctttcttttttgagactcactctgttgcccgggccggagtgtaatggcttgatcatagctcatcgcagcctcaaccttccaggctcaagtgatcctcccaccccagcctcccaagtagctgggactataggtgcatgccaccacacccagctaatttttaaattttttttgtagaaacgggctcttgctatattgcccaggctggtaaaaacatttttaaaaaccctaccatttactacaatattaaacagttgaccgggcacagtggctcacgcctgtaatcccagcactttgggaggcccaggcgggtggatcacctgaggtcaagcactcaagaccagcctggccaacatggtgaaaccctgtctttactaaaaatacaaaaattagcctatttgggaggctaaggtagaagaatcgcttgaacctgggaggtggaggttgcagtgagacaagattgtgccattgcattccagcctgggcaacaaaagtaaaactccgtctcaaagcataaaaaataaaaaaccaacaaaaaaaagtatatggctgggcatggtggctcacgcctgtaatcccagcactttgagaggccaaggagggtatatcgcttgagctcaggaattcgagactggcctggaaacatggtgaaaccctgtctctaccaaaaatacaaaaaattagccaggcatggtggagagtgcagctactcagcaggctgaggtgggaggattacctgagcccaagagttcaaggctgcagtaagctgtgattgtgccactgcactccagcctgggcgacagagccagaccccgtctcaaaaaaagaaaaaaaaagtataggaagaacataaactcagaatattttttgtttgtttgtttttgagacagtctcacactctgtcgcccacgctagagtgcagtggcatgatcttggctcactgcaaccttcacctcccgggttcaagcaattctcctgcctcagcctcctgagtagctgggattacagatgcacaccaccatgtatggccaatttttttttttttttttttttttttttttgagactgagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcccaattttttttgtatttttagtagaggcggggttttaccatgttggccaggctgatctcacactcctgacttcatgatctgcccgcctcagcctcccaaagtgctgggattacaggcgggagccaccacgcctggcccagaatatttttaatggaatacatttagttttaatgataaacttattactatccttacttttctaattttggtgcacacgattaaaaactgtgacctggtctgcagtgcatttggaaacatctaaggtacatagatgtttcatctatgtacatctaaggcacataaaacatactggtacaagagtaccaacatcctctttaaaatagtgaatctactctccatagaaaagaataatcagggctgtcaaattctaatatatataaaaatgttccaataggctgagcattgtaatctcaatacgttgggaggccgaagtgggtggatcacctgaggtcaggagttcaagaccagcctgaccaatatggtgaaaccccgtctctactaagaatataaaaattagccaggcatggtggcatgcacttgtagtctcagctcctcgggaagctgagacaggagaactgcttgaacccagaatgcggaggttgtagtgagccaagatcgtgccactgtactccagcccgggcgatagaacaagactccatctcaaaaaaaaaagttccagtaatatcatgctgaaaacactttaaagtcagtttcacaaagtgcctattagggggaaaaaacaaaaagacaataaagatacccatagaactcaactttatgcctttctttttcctggagtatcctccaaaaataaaacctgtgaaaatacaccagagcatccaagtaacatttctcacttcatgggactattatctaacaactaatataagagctaaataattatggccaactattgtaaaatgtaagtttttttttttttgataaagactctcaactcttaactgataactaacccatgaagcaagcttatttaattaattaatttatttatttatttatttttagagacaggggccttaatcttttgcccaggctggaatgcagtggcacaatcagctcactgcagccttaacctcccgggctcaagctcagcctcccacgtagctgggactactggagtgcaccactgcacctgactaattctttttttttttttttttttttttttttgagacagagtctcgctctgtcacccaggctggagtgcagtggcgcgatctcggctcactgcaaactccacctcccgggttgacgccattctcctgcctcagcctcccgagtagctgggactccaggcgcctgccaccacgccaggctaattttttttgtatttttagtagagacgaggtttcaccgtattagccaggatggtctcgatctcctgacctcgtgatccacccgcctcggcctcccaaagtgctgggattacaggcgtgagccaccgcgcccagccagcacctgactaattcttattttttgtagagatggggtcctgctatgttgctcaggctggtctcaaactcccggcctcaagcgatctacccaccctggcctcccaaagtgctaagattacaggcatgagccactatgcctggccaataattcttagttaccttggtatacttttcctatgggtgataataaaagcatatcatcctgtataagacaaatattatttttcagtttcccgtatcaataaggacaaaagcttgttcaaaagcagtagtgtccctatacttctagctgagggcctaagaagcagcatcactccagctgcaatgaacacacctagcattcagaactttgtttctaaataacattctctaataaaaggagccagggcccttgaagaagtggtcaattccagggctgaactaagcaagataaacctggatcatcttatagttctagaatgtaataaagtgcttttaaaaaaaaaaagtgagatagaggtatggcaaaaggacaaaggggtcaagatgaaagcggtcccaatggccaaaactagaataatccaaacaacagaatgaatatagtatacagagtccagagtataaaatatccaaatctatactgacataaatagttaaataaatgcaaagaaatgacaactcttccttacagaagaattttaattattaaataaaaatgaatgagagaaacagaaaagtcaccattgaaacacctgagtaatgactgttacaggcaagattaacctatgaatgcaaaaattagtaggcaaaaatttaaaaacaggatatttgcagagctccaaagaatagcccctaaaatgctgattaattacaaagggaaacagtcactttatggtggagaaatctggcagacactacattaaccaagggattatggctgacatcaccagtattagggcatttcaatatgcacccctgatccaatgcactgagaggaccatatcatctcaggggtattcttccccaaaatccattacctccgtcaaaccacaagaaaacattagacaaaaccaaattgagggacattctacaaaatacctgaccagagctcttcaaagtgtcaaggtcataaaagatgaggaaatgctaaggaactatcacagataaacgactaaggagatataacaactaaacgcaatatgtggccaggcgcggtggctcatgcctgtaatcacagcattttgggaggtcgaggcaggtggatcacctgaggtcaggaattcgataccagcctggccagcatggtgaaaccccgtatccactaaaaatacaaagattagctggcatggtggcagggacctataatcccagctactcgggaggctaaggcaggagaatctcctgaatctgggaggtggaggttgcagtgagccgagatctcgccactgcactccagcctgggtgacagagcgagactccgtctcaaaaaaaaaaaaaaaaaaaaaaggggggggcgggcgtgctggctcacacccgtaatcccagcactttggaggctgaagtgggcaaatcatgaggtcaggagatcgaaaccatcctggctaacatggtgaaatcccatctctactaaaaatataagaaattagccaggcgaggtggcgggcacctgtagtcccagctactcgggaggctgaggcaggagaatggcatgaaaccggaaggcggagcttgcagtgaaccaagatcgtgtcactgcactccagcctgggtgacagagcgagactctgactcaaaaaaataaataaataaataaataaaataaaaataaaaatgcaatatggaatattagatcatagaacagaaaaaaaattagtgaaaaaatggtaaaactttttttttttttttttttttttttttttttttacacagggtcttgctctggtgccaggctacatacagtgcagtggcatgatcatagctcaatgcagcttcctcatcccaggctcaagcaatcctcccacttcagcttcccaagtagctgggaccacaggtgtgcgccaccaaaccagctaactcttttttaattttatgtagagagggagtctccctatgttgcccagactggtcataaattccagagctcaaggcatcccctcgcctcagcctcccaaagtgctgagattataggcatagccactgtgcccagcaaaaatggtaaaatcttaacaactatggtttagttaatagtattgtaccaatgctatcatcttagttttgatcactgtactatgactatgtaggatattaacattgggggaagctgggtgaagggtatacagatctctctgcaatatttttgcaagtattctgtaagtttaaaatgatttcaagtaaaaagctaaaaaacaggctggtgcagtgactcatgcctgtaatcccagcactttgggaggcagaggcaggtagatcacttgaggtcaggaattcaagaccagcctgaccaacatggtgaaaccctatctctaccaaaaatacaaaaattagctgggtgtggtggcacacacctgtaatcccagctactcaggaggctgaggcaagagaattgcttgaacccaggaggtggaggttgcagtaggccaagatcacaccactgcactccagcctgggcaacagagtgagactctggctgaaaaaaaaaaaaaaaagtaaaaaacaaaaaacagtggtatctagtctctggatccagctgcctatttgcaggaaatagagatgatagaggaacatgttaaattgtatcatgatatataatcaggaaaattcaaactatgggagatctgtctggattcttcaatagataaacactatggaagagaaagggaacctgggaccctaaaaattaagagagattgaaaacacaaacaaaaacttttttcttaggggcaagactaagcctaacggcaaatgaactagggatgttcatttgagtaataaaacttttaaaaatacaaagatgtcattacatataaaagtcaggataatagttacttatgaaaagagtgaggggattgtgacgaaggggggcttctgaagtgagtggcaaagttctgattcttgacttggatgacagttacaaaaatgttcaccttacaataattcaccatagaatacattgttatgtgtgtcttacaaattctgtttaattttgtaataacggctttttttttttttttgagacaaagtcttgctctattgcccaggctggagtgcagtggcatgatctcagctcactgcaacctccacctcctgagttcaagtgattctcctgcctcagcctcctgagtagctgggactacaggctcctgccaccacacccagctaatttttgtatttttagtagagacaaggtttcaccatgttgcctaggccggtctcgaactcaagctcaagcaatctacccacctcccaccttagcctcccaaagtgctgggattacaggtgtgagccacctcgcctggccataaaggcttttttaagtagtggtatcagaagtgctcttcctgaccctgattcttttatttttgagacaaggtcttgttctgtcgcccaggctggagtgcagtggtgcaatcttggctcactgcagcctccacctcctgggctcaagccaccctcccacctcagtctcccaggtagctgggactacaggcacacgccaccatacccacctaatttttgtatttcttttttgtagaggtggggtttcaccatgttatccaggctggtctcaaactcctaagctcaagtgatctgcccacctcagcctgccaaagtgctgggattacaggcttgagccaccatgcccagcaaccctgattctcatagctgtagtaggggtgggtttctagataagtactaatagcttgggctctaccctgaactcaaaaagctaagcctatacgaactgtcaatctttgggtgaaagcctcaggaaagactaaaacatggcagaaagtttctaacattattcctgacagatatctaaacaagatgatactggtggaacagccatacctaaagattgctagctcttcatacaaaatattattagcgaggtcaccttgggcaaatgacttaatctctccatgcctcaattttctcatttataaaatggggttgataacagtttgccattttagagatcaaattagtgcattaacacacctaaagtgcttagaacaataccaggcatgtaaaaagcatcatatcattgttaatttctttcttttcttcttcctttttttttgagacggagttttgctcgttgcccaggctggagtgcaatggcgcgatctcggctcaccgcaacctctgccccccgggttcaagtgattctcctgcctcaacctcccaagtagctgggattacagtcatgcaccaccacgtccggctaattttgtatttttttagtagagacagggtttctccatgtcggtcaggctagtcccgaactcctgacctcaggtgatccacccacctcggcctcccaagtgctgggattacaggcgttagccaccgtgcccagcctgttaatttcttattaattttttagaagctcctgcttttgtcaaacaggaaattcattccttaaaaatttatttcttggccgggcgcagtggctcacacctgtaatccaccactttgggaggccaaggcaggtggatcacctgagatcaggagtttgagaccagactgactaacatggtgaaaccccatctctactaaaaacacaaaattagccaggtgtggtggctcatgcctgtaatctcagctactcaggaggctaagacaggagaatgaatcgtttgaacctgagaggcagaggtttcagtgagctgagattgtgccattgcactccagccagggcaacaagagtgaaactccttctcaaaaaaaaaaaaattttctttttttataaggcagagtctcactctgtcacctaggatggaatgcagtggcacgatctcggctcactgcaccctccacctctgcctcccgggcccatgcaatcctcctgccttagcgtcccgagtagctgagactacaggtatgggccaaacatgtccagctaatttttgtatttttttgtagagacagagttttgccatgttgcccaggctggtctcaaactcctgggctcaagtgatcctcccgcctcggcctcccaaagtgctgggattacaggcatgagccacaaaacccggcctggaaatttatatgtattttagttacactatcaaataaaccgatggatttgtagaaataggtaacagaaaagatatttttcctgttgaaatggatatgttatttgtgcctgcccaacatcaatcttcccttcttttggtaacagcaccctaatttttcctatgggataccccccttgtgtacattttgggtgagactgcctcctttccaaagaggtagatacatgacccaggcagactacagtaattgaccgaagaattggtatatgacccaaatcagttcaatgtgacttaattccagagctttcgttgcacttattcaaaaaaaaagaggtcaggcatggtggctcatgcctataatcccagcactttgggaggccaaggcagaaggatcgcttgaggccaggagcttaagaccagcctaggcaatatattgagaccccatctctacaaaaaacaataaaaaacaattagcaaagtgtgggagcatgcaccaatcccagctgtttgggaggctgagtcaagaggatctcttgagcccagaaggatgaggctgcagagaattatgatcatgccgctgcactccagcctgggagacagagtgggaccctgtctctcaaaaaaaaaaaaaaaaaaaaaaaatcagtccatactatagccaatcaaaatctatttggatttggatccagggcccctttacccaaagaactgatcattcaaaaatttaaaatgtcagcccggcgtggtggctcacgcctgtcatcccagcactttggaaggccgaggcgggtggatcacgaggtcaggagatcgagaccatcctggctaacatggtgaaaccccgtctctactaaaaatacaaaaaattaaccgggtgtggtggcgggtgcctgtagtcccagctactcgggaggctgaggcaggagaatggcgtaaacccgggaggcggagcttgcagtgagctgagattgcaccactgcactccagcctgggtgacagagtgagactccgtctcaaaaaaaaaaaaaaaaaaaatgtaaaatgtcatgtgaaaccagaaggagtcctactttactatttttaaattcctgccttttagggtttatataatcagctgctttaaaaaatatcccatttaaggtaccctttgaagaaaagtaatgcttacagatgttgtaccttccctcccaaatgatacaaataatcatgctgatttagtcagatccagatgatgggtggttaacaaatctctctctctttctagtcctgacactggcctcaagctccagacctaaacctgtcagtattgtactatcacattatacacacatgaaacactactatgtcctttctgattcatctatttcagcccatgtcagcactatttttcctaatatctcaactcaaaaccttagaattcacctttttggctttcattattgtgttgagcttcaacatggattatctcgttgaacaggatacataatttcctattttacagatggaaacactgacgttagaattcatacagcttggccgggcgtggtggctcacgcctgtaatcccagcactttgggaggccaaggcgggcggatcacgaggtcaggagatcaagaccagcctggctaatatggtgaaacctcgtgtctactaaaaatacaaaaattagccaggcatggtggcatgtgcctgtagtcccagctacttgggaggctgaggcagaagaatcgcttgaacctgggaggcagaggttgcagtgagccaagatcatgccactacactccagcctgggcaacagactgagactccatctcaaaaacaacaacaacaaaaaaagcttggcgcagtggctcatgcctgtaatcccagcactttcacaggtcaaggcgggcggctcacctgaggtcaggagtttaagaccagactagccaacatggtgaaacttatctctactaaaaatacaaaaattagctgggcatggtggcgggcacctgtaatcccagctacccaagaggctgagacgagataacagcctgaacctgggaggcggaggttgcagtgagccgagatcgcgccattgcactccagcctgggcaacaagagcaaaattctgtctcaaaaaaaaaaagaattcatacagcttataagttgcagaactagagaaagagtcaaaccttttctgagattccagaccctgcactcttaattaccaaacaacactgtctcatctttggatccttcacctgtccatcctgtaagtaacctcctgtaagtaaccagatcctatgctttcttctcttccacatttattcaacagtaactacacacctactgtatgccagacataaaagaattcaggaatgaataaaacagaatccttcaaggagctcataatatagtggaaaaggccaggtgtggtagcttatgcctgtaatcccagcactttgagagacccagatgggcggatcacttgagcccaggagtttgagaccagcctaagcaacatggtgaaaccccatctctacaaaaaatacaaaaaaataataataataacaagtagggttggtggtacatgcctgtagtcccagctaccaactacttgggaggctgaggagggaggatgtcctgagcccgagaggtcaaggctgcagtgacccattatcactgcactccagcctgagtgtcagagtgagaccctgtctcttgaagaaaaaaaaaaaaaaaaagaggccaggcatggcggctcacacctgtaatcccagcactttgggaggccgaggaaggcagatcacctgaggtcgggagttcaagaccagcctgaccaacatggagaacccctgtctctactaaaaatacaaaattagccaggcatggtggtgcatgcctgtaatcccagctgcccaggaggctgaggcagaagaattgcttgaacccagggggcggaggttatggtgagccgagatcgcaccattgcactccagctagggcaatgagagtgaaactccatctcaaaaaaaaaaaaaaaaaaaaagagagagagagaaaatgtggaaaaaccggatataaacaggtaattatgagataagaaatgctcttagtagggtgtagaggaagaagggcctaatactgcctcaggttttcagttatccagaagaaaacaggaaccaaatggcttcgattcatttcaacagaaaaataatacgcagaggtaacaaatccaagctcttacaatctcagacatgaattattactatctttattaccattccccaactaggaaacctgggcaaattaacttctctaaatttcagttccctcatctgtaaaagggggaaaataacaccatctatcacatagaaataaatgtgaggactaaatgagaaaaggtatatgttaccatttttagaaaccttaactctattcataaaacacccattcattatgccgttccccataccaacattctatgggataacatcaaaacgttagccttggccaggtgccatggctcacgcctgaaatcccagcactttgggaggccaagtgagactgcttgagtccaggagttccagaccagcctgggcaacatagaaagaccctgtctctaaacaaaaaacaaaaacaaaaacaaaaaaactttagcatttaaaggacacaaaggggacttctggggtgctgatactgtttcttgaactaggtgctggctacatgagtgaatacagtttttaaaaattcattgaactctacacttacttaatatgcattgtatgtatactgtacttcagtaaaaaaaaaaaaaaaaaagttgtttgtttttttttaatcatcaaactctggcctaaacctagcttccaccccattactcccctgctttggacatttcacatccttgaacgtttcttcatcctatttactttctgctacctggaactctccttttctctaatctccctttcaaaaccctacatccttcaagagtcagctcaaatcccacattctggaaaactggaaaggtaggggatagtttattcagggtcagaatactaaggaaggaactgggtggacacataaagtatacttttcatgaattattataacgatttgtctccctcactagcctgtgcagctacttcaggccaacttcgctttctcgctgtaggcgttagtataaaacaatgttcggtgaagaacttagtaaggaacagtaacaaaaattgccctgcaagtcccagactgagaagagacgtctaaagcacacgcacactctcctcgcttaagcaaaattggtcccctcatcccggaccccctcacacataaccttttatcccagggagcacccctggcgatcccgccccaaatcccaaactcctctgcaagccgcgctccacaagcacctcctcctcttattccaacccttcccacagaccacactcctcggctcaggacactgaatgggacacgccccctcagatccccaccactaggtggtccggcccccagggcccaaacctcacgacactgtccccacgccccggtccccacgccccctcccctcaccagccccgccctcaggccccgccctctccaagaaccccacgagacagtcagttagttctctaggaaccgcgcgctggcggtcactgcccccgcctcccattcacagaggccgcgggagggcaggtggggcctgacagtctgctcgagccagtggcctcacctctcttccaagagctcagtggggacaccacctccacccgctcggaaatgaactcggccagactggagcggaacaaggccgcccgcactgtcacagccaccaccagcaccaggaccaagggagccgccatgataactggggcgggcgcgcgggcggggagggaaggcgaggcggaggagcctcgcgcgctgtgcgccacgctctgtagttccgcgggtgggcgcgcgctgccgctggcgccggagaggccagacgtggggactacggctcccagaaagccttgcggcgaggcgggccggagcgacggaaagcgggcgcctcaagctgcgtatgcagaaggtggggcgaaaccttctacgatcgcaggtgttttgtgaagccgcgccgctatagcggggctgaaacgctgctgaaagtagaagcggaagtagtcgccttcctgggattgtgagagacttttaaacagatgttaaattcactcttgcgtgtatgttttcaatgccaaaatgtttatttttatttttatttttattttttttgagacggagtctcgctctgtcgtccggctggagtgcagtggcgcgatcttggctcactgcaacttccgcctcctgggtagctgggatgacaggcgcccaccaccacgcgcggctattttttttttttttttttttttgtatttttagtagagatggggtttcaccatgttggccaggttggtctcgaactcctgacctcaggtgatccgcccgcctcggcttcccaaaatgctgggattacaggcgtgagccaccgcaccctgcccaaaatgtttatgttttttgtttttgagacagggtctcagtgccgtcgcccaggctggagtgcagtggcgcaatctcagctcactgcagcctggacctcccgggctccagagtagctgggaccacaggtgcgcgccaccacacccggctaagtttttgtacttttagtagagacggggtttcgccatgttgcccaggctggtaccttttatgtttttaaagagtgttaaatgtgtattttttaaaaaatttattctggcagttgtttgttaaacgccaactattttccaggcactatgttaggttctacagatgcgttttggagtagtagactgatttattagctagttcaacaagtcgcttaacccttgtgtgctgaaaaatgtgctgattataggctaactagggacagttgaggaaggcttagaaattttttttttgttttggaaacggagtttcgctcttattgcccgggttggagtgcaatggcgcgatctcagctcactgcaacctccgactcccaggttcaagcgattctcctgcctcagcctcccgagtagctgggattacatgcatgcgccatcacgcccggctaattttttgtaattttagtagagacagggtttctctatgttggtcaggctggtctcgaactccagacttcaggcgatccacctgcctgcctcggcctcccaaagtgctgggattacaggcttgtgtcatcgtgcctggccggaaggcttagaaattttgccagtcgcttttaaacacaggcatttttgaaaattaagacatataaacctacagttaaataacttatattgaaaacaacggaatacatattcaacacgtcactttctaattattttactacacttttttttatatgtgcttttgagattatttaccaccgctgtatcagtacagcaaatactatctctttctcttcccaaatggtggtgttcagtttcctcaggttgatagattgaaaatccctcccaatgcgagtgtttacaccacaggaatcagcaaacactacaaatcaggggtttggggtttggagagcccattgataagcattaagcagcacacttcattaattaatgtatagtaagtgcttaaatattagcaataataatattaaatgtgcaaggaaatttcatatttgtgaagaaaaggaaacaggctggacgcagtggctcacgcctgtaatcccagcactttggaaggccgaagcagccggatcacttgaggtcaggagtttgaaaccagcctgcccaacatggtgaaacctcgtctctattaaaattacaaaaattagccaggcatggtggcctgtgcctgcagtcccagctactcaggaggctgaggcaagagaatcacttgaacctgggaggcggaggctacagcgagccaagatagcgccattgcactccagcctgggcgacagagccagactctgtctcaaaaaaagaaagagagagaagaaagaaaacgaaacagtgtatgactgagaataactgctggtgtaataataagggtggtaacactagacaaggtgatcagggaagactctagaaagaggtgatatttgagctgagacctaaaggatgagaaattaatcagagcctccaagcagaaggaacggactgagtggggaaagagcaaggtatgtttgaggatcagaaagaaaacaagtatggctcaagtggagagaatagaagaagctgtggatggagagacggggggcaatcaggtagggacctattggccatgcttgagaatttgggctttattcaaagtgcaatccatatgccattggagaattttaaaccagaaatgatgtgaacaggtgtacatttttcaaacatctctatattcccacaagccctctattgggtgttggggaatattgcagtgacaaaatggcaccatctgcctttgcccttatgtaacttggaaagcagttgaagagataaaatagttaaagaataacataagtaaaatcacaaaccataactccagcctgggcgacagagcaagactccgtctcaaaaaaaaaaaaaaaaaatcacaaaccttaatgagagaaagaaaagggggagtgggccaggcgcagtggctcacgcctgtaatctcagcactttgagaggccatggcgggaggattgcttgagcccaggagtttgagaccagcctgggcaacatggtgaaacctgtctctacagaaaacataagaattacccaggcatggtggcgcatgcctgtagtctcagctactgggaaggctgaggtgggagaatcacttgagcctgggaggttgaagctgcagcgagccaagatcacgccgctgctctcaggcctgtacgacaaagcaagaccttgcctcaaaaaaaaaaaaaaagaaaaaagaaaaaaaatggccgggcgcagtggctcacacctgtaatctcagcactttgggaggccgaggcaggcagatcacttgaggtcaggagttcgagaccagcctggccaacatggtgaaaccccgtctctactaaaaatacaaaaaatttagctgggcaaggtggcgggcacctgtaatcccagctacttgggaggctgagacaggagagtcacttcgacccgaggatcggcggttgcagtgagccgagattgcaccactgcactccagcctgggcgacagagcaagactgtctcaaaaaaaaagaaaaaagaaaaagaaaaaaatgggagtgggattctaaaagaatgcaaaaataaaccctggggctgatagctttctggaccagtgaaaggggtagggtctcctttgggggaggggatcatgaagaaattagaggggcactcatcctttgagcccctgctgtgtgccaagtagtgtaccatatgcttaacacacatgagcttatttagtctgcacagccttccttcttaaagatgtgggtttttgtatccccttttacataaaaggagatatatgtgttgcatcatcttacagtgaagtgtattacatcataaaaagtggaagtaattgtaacactaacctcatagtgaatattgagcaaggttatacaatgtaaaatgcttagcacatacccagtgctcagtaaaggttacttagctgttatattatttacatcattctaacagatgacttaaaaatttatcttagggtgaggattgtctttgggaaaaacagtgattagccattgtagacagatgtgacccaaaccagtggttctcaaaatgagtgtgcatgaagtatgaatacaactagtggttctcaataaaaaaacacaagacccaaatacagaagctagaattataaaactcataaaagaaaacataggagtaaacttttatgacctttaattaggcaatggtttcttagataacaacaccaaaagcacaggcaacaaaaggagaaataagtaaattgagctttgtcaaaattaaaaacttctgtgttccaaaggacaccatcaagaaatgaaaactgctgggcacggtggctcatgtctgtaatcccagcactttgggaggccgaggtgggcagatcacttgaggtcaggagtttgagaccatcctggccaacacggtgaaaccccgcctctactaaaaatataaaagttagccaggaatggtggcgggcacctgcaatcccagctatcgggaggctgagacgggagaattgcttgaacccaggagctaatgttgcattgagccgagatggtgccactgcactccagtctgggcaccagagcaggactctgtctcaaaaaaaaaaaaaaaatttaaagactgggcgcggtggctcacgcctgtaatcccagcactttggaaggccgaggccggtggatcacaaggtcaggagttcaagaccagcctggccaagatggtgaaacccccatctctattaaaaatacaaaagttagccagtcgcagtggcaggcacccgtaatcccagctacttgggaggctgaggtgggagaatcgcttcaacctggggggtggaggttgcggtgagctgagatcatgccactgtactctagcctgggcaacagagtgagactccatctcaaagaaaaaaaaatttaaaaaagagaaatgaaaactggctcaggcctgtagtcccagcactttgggaggctgaggtgggaggattacttgagcccaggagttcaagtccagcctgagcaacatgataagacccccatctctacaaaaaattaaaaaaaaaaaagccaggcacagtggttcacacctgtaatcccaacactttgagagaccaaggtgggtggattgcttgagctcaggatttggagaccaacctgggcaacatggcgaaactccatctctatttaaaaaaaagaaaaaataaatacaaaaatgagccaggcatgatggcatgcacctgtagtcccagctactcgggaggctgaggtgggaggactgcttgagcctaggaggcggaggttgcagtgagccaagattgtgccactgtactccagcctgagcaacagagtgagaccccttcaaaaaagaaaaaagaaaacccacagaatgggagaaaattatctgcaaattatatatttgagtagggacttatccagaatgtttaaagaactgttacaactcagtaataaaaagacagtaataaaagacaaatacccaaatggagaaaggaattgaatagacatatcaccaaagaagatacacaaatggccaataagcatgtaaaaagatgctcgacattattagttattagggaaatgcatatcaaaaccacaatgcgataccatttcaaactcaataggatagctataataaaagactgacagtagaccaggcgcgatggctcatgcctgtaatcctagcacttttgggaggccaaggcgggcagttcatttgaggtcaggagttcaagaccagcctggccaacatgttgaaaccccgtctctacaaaaaatacaaaaattagctaggcatggtagcacacgcctgtaagcccagctactaaggaggctgaggcaggagaattgcttgaacccagggggcagaggtttcagtgagccgagatcacaccactgcactccagcctgggtgacagagcaagactccatctcaaaaaataaaataaaaataaaactgacagtaacaagtgttgacaaggaagtggagaaattagagcttttatacatggcaggtgggaacataaaatattgtatccactttggaaaacaggttggtatttcatcaagatgttaaacagaattgccttatgacccaccaactcaacacctagctatatatctgagagaaatgtaaacgtatgtccacaaaaaaaattatgcacaaatgttcatagctcattcataaaaccaagaagtggaaataacccaaatgaatggataagcaagatgtggtatacctacaatggaatataactggacaataaaaaaaaatgaagtagttatccatgctgcaacatagatgaaccttgaagacattatgctaaatgaaataagccagtcacaaaagaccacatgctatgtaattccatttatattaaatgtccatgggtgggcgtggtggcgcatgcctgtaatcccagcactttgagaaactgaggcgggaggattgcttgagccccaaagtttgataccagcctgagcaatataggggagactccgtctctataaaaaagtaaaacatggccaggtgcggtggctcacccctataatcccagcactttgggaggccaaggtgggtgcgtcacctgaggtcaggagttcgagaccagcctgaccaacatggcaaagcctcatctctactaaaaatacaaaaattagccgggtgtggtggcatgtgcctgtaatcccagctactcaggagactgaggcgggagaatcactttgaacccaggagacagaggttgcagtgagcgagactacgccactgcactccagcctgggcaacagagcaagaatccacctcaaaaaaaaaaaaaaaaaaaaaaaagtaaaacattagccaggaatggtggcaggcacctgtggtcctagctactcaggaggctgagacaggaggatcacttgagcctaggaggtagaggctgcagtgagccgtgtttgtggccactgccctctagcctgggtgacagtgagactcttcctcaaaaaatattaaaaaagagagaaatgtccagaagagtcaaatttatagaggcagaaagtagattagtgcttgcctagggctgggggtggtgactgggggagtagggaatgggaaatgactgccaataggtacggagtttcagctgggtgcggtggctcatgcctgtaatcccagcactttgggaggctgagggcgggggtggatcacctgaggtcaggagttcaagaccagcctgaccaacatggagaaacgctatctctactaaaaatacaaaattatctgggtgtggtggcgcatgcctgtaatcccagctacttgggaagctgaggcaggagaattgcttcaacccgggaggcagaagttgcggtgagctgagatcacgccatttgtactgcagcctggacaacaagagtgaaacctcatcttaaaaaaaaaaattagtaagcatcagaatcacgggggagatgtattttttattttatttatttttatttttcataaatagagatgggatcttgctatgttgcccaggctggtcttgaacgcctgggctcaagcgatcctcctgcctcagtctcccaaagtgctgggattactggcatgaccagcctagatttttgaagtgtaaattttctagttctgacctagagactaggcctggtgtggagcccaggaatctacattcttaatctctccaggtaattctaatgtttgtgattcagaagccataccttgggaaacaaaaaaataaccctgaaggcgtaggtgtccagtagcttacacaaaaaaagatgaatatagtaatgataactagcaaatattgagtgcttactaggtgctaagtactgttttaagtgctttacacatattatctcatttagtacatgtaccgttacaagtgctatctattatttctccatcaccaatgaggaaacagaggcacaaagaggtttagtaacttgcctaaggtcacatggctagtaagtggcagaaccaggatctgtctgttagctctagatactgtggtcaagctgctctgcctgagaaaatgagaagaatttgggttgtgttggattgggttgtgttgggttgggttgcgttgggttgggttgggttgtgttgggttggattggggtgctttcttgttgtagctgagaaggaagggtagggaatagaaaggaaggagataataaaggagcaatcatggtgttttgttttgtttttttcctgtgacaccagagattcctgtgatatgtgggttacctagagaggaagaaattgaggtgctaagatactaagtaaccactggaatgagtgaattgcaatcagtttttaatgaccttgcatctttccattcaagaatcagcattcttggaaaaagcgcaagattgattaagattaggtcttgtgcccaatcttaatcagccagaaaagtgtatctgtgagaagtcagatgatgaatttaccatattcgcctgaggacagcacaccctaaaggcaattggatgaagtcagttcgaggaaggcgaaagggtacagtcctgtgctgcataaagacattttggtcaacgttggactgcatataccacagtggtcccctacgattatagtggagctgaaaaattcctcttgcctactgatgttgtagccatcataacatcgtggcttaatttgttatcttttctatgtttccatatgtttagatacacaaatacttaccactgtgttacaattgcctgtagtatccagtatagtaacatgctgtacaggtttgtggcctgcaagcaataggctataccatatagcttaggtgcgtagtaggctttaccatctaggtttgtgaacctgctaataataatagtgatgacaaagacagacccaggcctccctgtactgtggtttatagtctagcagggagtcatacaaaatagaagtaagcaaacaaaataattagggactgtgaccacaccaaaataagtagggattgtgagggcaaaagaccaggaagaatgataatgaataatggaggacctactgtatattggatggtcaagaaaagcctttctgaagaggtgatatttcagctgacacccaaaggatgggaaggagccattgatgtaaagagttggcagtggtatgtattggaaggaggggatggaggttacaaacagcttgtaatgagggaggccaatgtagtcggagtgatacgagcaagatgtgagactggagaagcaggcaagggccagatggccttggtggactatggtgctaagttggatttttattctaagagaaatgggaagtgcacggaagggtttcaagttgagttggaacataatcatcatttaaagtttaaaaatatgcctctggccaggcacggtggctcacgcctgtaatcccagcactttgggaggcccaggtgggtagatcacgaggtcaggagttcaagaccagcctggccaacatggtgaaacaccatctctactaaaaatacaaaaattagccgggcatggtggcaggcgcctgcaatcccagctacttgggaggctgaggcaggagaatcgcttgaaactggaaggtggaggttgcagtgagccaaaatcacgccactgcactctagcctgggtaaacagtgtgaaactctgtctcaaaaaaaaaaaaaaaaagaaaagaaaagaaaagaaaatatgcctctaaggctgggcatggtgattcatgcctgtagtcacagcactttgggaggctgaggcaggaggattgcttcagcccaggagtttgagaccagcctggccaacatttcaaaaccacatctctaccaaaaaaaaaaaaacaaaacaaaaaaaaaaaactagccaggtgtggtggtgcacacctgtggtcccagctacttgggaggcttaagtgggaggatcacttgagcctggagggtcgaggctgcagtgagccatgatcgtgccacactgtactccagcctgggcgacagagtgagaccctgtctcaaaaaaaatttttaaaaagacacagcaaaggcctgatctgtgtgactgcggattttttaccagaagacaataaactacataaaaatttaaaaacaaacagtaacaaccacgtgggtgggtgtggaagtcagtagcatgtacgaaaaggtcattaaaggcttctttgaggtcgcaaaagtaaaaagggcctgatccagttcattgtacagattgggaaaaataaagcccagaggagcagtgccaggcccaggatcacacagcaagtcaatagtggcacttggcccagaaaccagggttctcactatcggccttttatactaacggcctcctggtcctgggctggagtctcccgtgaggcccactgggagacccatataccagctccctcctcaatctgagacccaagtattgtaagggcccaaaagaaggatttggatttacataacgccctgaggacagatttctgaaacccttccttcctgtcccctactcacaaatacccactattgtaaaagctatcctgtagcaacaagaccaaaatgtaaacttggcctaaaactggaaagctgtagataggctcttgcacctccaactttctttctctgaatccctctcactccccaggagccacactccctacaactgtgcatccaggcctctcatccccatcccccaaatatacacacatttctctgctctgagaaaggagataggtttgcttgttgcttcctggtatccattccccctttccctgacatccattagaaactcaaagatggctgggcacagtggctcatgcctgtaatcccagcactttgggaggccgaggtgggcggatcatgaggtcaagagatggagaccatcctgccaacatggtgaaaccctgtctctactaaaaatacaaaaattagctgggcgtggtggcatgcgcctgtagtcccagctactcgggaggctgaggcaggaaaatttcttgaatccgggaggtggaggttgcagtgggccgagattgtgccactgcactccagcctggcgacagagcgagactccgcctcaaacaaaaaaaaaaaggggaactcaaagatttgctgaatgaatgaatgaatgtgcaaatgaatgaatgaatgaatatctctaattcctttcttaaaactcttcattggctttccattgcacttaatttaagaaccataattctgaggccgggcacggtggctcacgcctgtaatcccagcactttgggaggctgaggcgggtggatcgcttgaggtcaggagttcaagatcaggctcagggcttagacatcccaatgataactgagactttgagctttgactcagagggaagcacaagggcgagttccagatgacaccctaaggctcatcttagggtggaagtctaaagtggtacagcactttgggagagtaacttgacagcatctgttaaatttgaaatgtacatacctatcaatcttgcagttgacttctctgaaaactattctgtatatccaaggatagtcactgtagcattcattgtggcagctaacatggtgaagccctgtctctactgaaaatacaaaaattagctgggcctggtggcatgcttgcaatcctagctactcgggaggctgaggcatgagaatcacttgaacccaggaggcacaggttgcagtgagctgagatcgtgccactgtactccagcctgggtgacagagcgagactctgtctcaaaagaaacaaaaagaaagcatatactccaagcattatctattacagttgccttagtcatttacttcacactcctacgggcctcagaatactttgcaacaatctttactatctccgacggagtgtacagctcaacattctttatagccacagggttttatagacttcacatcatcattggctcaactttcctgctgccttctacgccaactaccatttcactttattcaccgttttggatttgaagctgctgcttgatactgacattttgtagatgtagtatggctatgccggtacgtttctgcctattgaagaagatcatgttcttttagtattaaacagtacagttgacttccaatcaattagtttatatataggaatcttgtgtagcctgcagtggggttgtggggagcaaggcagaagcagccactccagagaggatttacatttatttcttccaggcatctgagagatcatttcagagtgggtcgctttttatattaatttctcagcttcgagattcccagccatgcaggtgatgcaaatgtgaacgccagactcatggagggtaggcatgtggtttcaaattctcaggagattattttccctcttacccaaagaccaggtcaagatggacacatcctttttgtctcccttcgctagtaggtgttggtttttcccctagtttgttctttcactgtgggtgtagcccttcaagggtcctagatttatcaagggtctcagttgcaacctctaatttcatataagcccaaagcttcaactccccaaatgtttctttaaaaacacaagctattgcagattcagttgtgccttttaaaggatgtttgttgtttttatttccagcatctccttgggttgtgtagcaggaagttcctgatattgtcagaaaaggaagtccaactcagtatttagtacaactgtctgtttacttgtctattttctccatgagtgtcaagctctgggaggtcaggaactaaggctgactcatctctgggacaaaacaccaggcccaagatctggcacaaagtaaatgctcagtgcgtttgttgatactgaacctccacttggtcacttctaatgatggggagctcactttctcccaaggtggcctctttcctttagagagggtgtgtgacctgagtgaccaccgggctaatgggggacagcctgcccctcatttatgtacaaccttcccaatacttagcttgtccatccagattctgcagaagggggctcaaggcctagacatcccagtaataactgagactttgagctttgactcagagggaagcacacgggccagttccagatgacaccctaaggctcatcttagggtggaagtctaaagtggtacagcattttgggagagtaatttgacagcatctgttaaatttgaaatgtacatacctatcaatcttgcagttcacttctctgaaactattctgtatatccaaggatagtcactgtagcattatttgtggcagcaaacaattgaaaaccacccaaatgtctgtcaataagaataactaaataaattctctaaagtcaagtcatacagtggaaaactgtgagccttttatttttgtttttttgagacagggtctcactctgttgcccagactagactgcagtggcgccatcacggcttactgcagcttcaaccttctgggctcaaaggatcttcccaccttagcctcccaagtagctgggactacaggtgcacactaccacacttggctaattactttttatttttgtagagatgaggtctcactatattgcccaggctggtctcaaactcctgggctcaagagatcctccaacctaggcctcccaaagtgttgggattacatgcgtgagccaccacacctggcctatgtttttttttggtttttttttttgagatggagtctcgctcttgtcacccaggctggagtgctgtggcgcgattccggctcattgcaatctctgcctcccgggttcaagtgattctcctgcctcagcctcctgagtagctgggattgcaggcgcctgccaccacgcccagctaatttttttacttttagtagagatggggtttcgctatgttggccagtcttgtctcaaactcctgacttcaggtgatccagctgcctcagcctcccaaagtgctgggattacaggtgtgagccactatgcccggcatgttttttttttttaataaggtagatctatgtatattgacataagtggaattccaagacatgttgctgtgagtctgtaagacagagtgtataatatcaagaaaacagacaaacctataagcagtgtaaattggtacatcatggaggctatttggtaatatcagtcaccttttttttttttttttttgagatggagtcttgctctgtcacccaggctggagtgcagtggcgtgatcttggctcactttaacctccactcccgggttcaagcaattctcctgcctcagcctcccgagtagctgggaatataggtgtgtgccaccacggccagctaatttttgtatttttaatagagaaggggtttcgccatgttggccaggctggtcatgaactcctgacctcaggtgatccatctgccttggcctcccaaagtgctgggattataggtgtgagtcaccgtgcccagcctaagtcaacttttaaaatgctatttaaacttttaaaataacctcaactgactaatccccactaatagatatttatattacaaataaatatgcaaaataatgggtaaaaatattaattgccacattgtaataacaaaatattggaaacaaactttttctccttatgagactggatatatagagtgcatctatttgatgggatactatgcaggtttgaaatagaatgaggctgctctccatatcgatatggaaaggtctgcaagatagagtatgaagtgatgaaaaaacaaggtgcagaatagtgtctctatgtttatgaaaaatacatgtattatatgttggattttattattttattattaattttttgagacagcatctcacatctcactctgtcacccaggctggagtgcagtggtgcaatcatggctcactgcagcctcaacctcctgggctcaagcaatcctcccacctgagcctcctgagtagctgggaccacagggctacaccaccacgcccagctaatttttgtatgttttgtaacaacagggtttcaccatgttgcccaggctggtcttgaactcctgggctcaagtgatgctctcgcttcagcctcccaaagtgctaggattacaggcatgagccaacatgctcactctgcattggatttgaaatgcatagaattcctctggaaggaatcacagggaactggaattggttacctccaggaaggagaccaataattgggaactgggaagggaaggacacctgcaaacgctgtactccctattgaagctttgtaattttgaactatttccttacaattaagtaaggaagtaaaaaatgttaaaccataattgtaaaactggaagcaaaacaagctgtacaaaacactttctatatgtacatacacatgttgtgtagaaaaagaaaagaaggatacacttcagactggtggcagtggcagaagttttctgggactggataacaaagggtggtcaagggtgaccttgactttatctttttgttgttgttggggttttttgtttgtttgtccgttttgagacggggtcttgctctgtctccaggctggagtgcagtggcagaatctcggctcactgcaacctccgcttcccaggttcaagcgattcccctacctcagcctcccaagtagctgggactacaggcgtgtgccactaagcccggctaaattttttcattttagtagagatagagtttcaccatgttggccaggatggtcttgatctcctgacctcctgatccacccgcctcagcctcccaaagtgctgggattacaggcgtgagccaccgcgcccggcctgttgttgttgttgttgttgttgttgttttttaacatacagggtcttgctttgctttttttgtttgtttgctttggggttttgtgtttgtttgttttggagttttttgtttatttgttttgagatgtcatccaggctgcagtacagtggtgcaatcatggctcactgcagcctgaaccttccaggctccagcaatcctcctacctcagcctctggaatagctgggactacaaatgcatgtcatcacatgtcgcttttatttttatttttattttttgtagagacaggggtctcatcatgttgctcaggctggtcttgaattcctgggctcaagcagtcttcctgcctcagcctcccatagagctgggatcacaggtatgaaccaccatgcctagccttgcttagatttttatataatctttctgttaattgttactttttttttttgagatggcgtctagctctgttgcccaggctggagtgcagtggcacgatctcggctcgttgcaacctctgcctcctgggttcaagtgattctcctgcctcagcctcccgagtagctgagatcacaggcacctgccactacacccagctaatatttgtatttttagtagagatggggttttgccatgttggccaggcagctggctggtttcaaactcctgacctcaagtgatttgcccacctcggcctcccaaactgctgggattacaggcgtgagccacagtgcccagcctgttacatcatttaaaatccattttaatctttaaaagtaggcttcaggtggatggaacacaaccacagcctggcaaaggaatgaggctgactctcctccttctgagggaagtattcatgttgtgctctttgtcccactgccttccccaaggacagcctggctcagtggaggcaccggggctactcctggcatcattccagagagcctctcttgtcacctcttacccacttggctccctgtcaccagtgttctgggctgggctgagaagcagcacagattaactattgggttgtatctccagaagccccatcgatgtcaggttgggcagagccagcccaggaaacatggaacatctgcctctggcctctcacctctttgttctcctacgaagcccggcttttttttctttttttgagacggagtctgctctgtcacccaggctggagtgcagtggcgcggtctcagctcactgcaagctccgcctcccaggttcaccccattctcctgcttcagcctcccgagtagctgggactacaggcgcccgccaccatgcccagctaattttttgtatttttagtagagatggggtttcactgtgttagccaggctggtctcgatctcctgacctcgtgatccacccgcctcagcctcccaaagtgctgggattacaggtgtgagccaccgtgcccggcttgccctttttttttttttttatagattttggcagttacttggaatattctttccctttgatactccactacctttttcctcataccccaatttatatttctgtctcatctcattcagtggagaggaggcatctgaaaaacccatcaactagatgtgcagggatttaatgttcctacattaattgtattttaggaggcatctaaaaaggacgatgcttaactatgaggaaacacacaataatgatggaattcctagcaccggtggagaagagatcctgaggcagaaaggccttgctatcactcttcagtcatgttgataggcaatgctacaaagggcttaagaacgtggcactgaggctgggcactgtggctcatgcctgtaatcctaacactttgggaggcccaggcaggaggattgcttgagcccaggagctcaagaccaacataggcaatatagggagaccccgtctctatacacaacaacagcaacaaaaattagacaggcatggtggtgcatgcatgtagtcccagctaatggggaggcagaggtggaaggattgcttgagcccaggaggttgaggcttcagtgagctgtgattgcaccaccgcactccagcctgggcaacagagtgagacctcatcttaaaaaaaaaaaaaaaaggccaggcccagtggctcacgcctgtaatcccagcactttgggaggccaatgtgggcagatcacaaggtcaggagattgagaccatcctggctaacatggtgaaaccccgtctctactaaaaatacaaaaaaattagctgggtgtggcggcgtgcacctgtagtcccagctgctgcagaggctgagacaggagaatggcatgaacccagggccaagaccgcaccactgcactccagcctgggtgacagagcaggactccgtctcaaaaaaaaaaaaaaaaaaaagaatgtgggcactggagccaggctgcaggctgacagattcgtatctgtcacttagcagctgttgaacctttgacaaataacctgtctgtgcctcagtttccaaatctgcaagatggagataagagtagctcctttataggactgttgtgaggctgtaatgagatattacatgaaaagcctgtagtcccagctactcaagaggctgaggctggagtaccacttgagcccaggagttcaagtccagcctgggcaacatagtgagaccctcatctctaattaaagaaaaaaaaagagatttaatctctctgtaatccccatcactttgggagtctgagacaattggatctctggagcctgggagtttgagaccagcctgggcaacatggtgaaaccccatctctactaaaaatacaaaaattagccgggcatggtggcttatgcccatagtcccatatactcagcaggctgaggaacaaagaattgctcgggcccaggaggcagaggttgcagtgagccgagattgcacttgggtaacacagcaagactctttctcaaaaaaaaaaaaaaaaaaaaaaaaaaaaatcggccgggcgcggtggctcacacctgtaatcccagcactttgggaggccgaggcaggcggatcacgaggtcaggagattgagaccatcctggctaacatggtgaaaccccgtttctactaaaaatgccaaaaaaaattagcaggtcgtggtggcggccggcgcctgcagtcccagctactccggaggctgaggcagaatggcgtgaacccgagaggcggagcttgcagtgagccgagatcgcgccactgcactccagcctgggcgacagagcgagactccgtctcaaaaaaaaaaaaaaaaaaaatcaaagggcctccgatctatgccaaccactccttaagatccctttggttctcaccaatctctcatatcccaccactgcctttcagtggccttcactcaccaaacctgttactcttcatcaaaaactgtacccctaggccctttccctcaggcctcgctttttttctttttttcctctcacctctccatcctgtccctgttaccctgttatctcagttccatatctcaaaagcctagaaaggcagacaagacagagctctccttaaaaagtgatgggcaggccagctgtggtggcttacgcctataatcctagcactttgggagatcaaggcaggaagatcacttgagaccaggaattgggcaacatagtgagacgcggtctgtacacaaaattttaaaaattagctgggcatggaggtgtgtgctgtagtcccagctactcaggaggctgaggcaggaagattgcttgagcccaggagttcgaggctgcagtgagccacgattacaccactgcactctagcctgggtgtcagagaccccatctctaaaaaataaaaaaagtgaaggccaggtgcagtggctcacacccgtaatcccagcacttcaggaggccaaagtgggaggactgcttgagcccaggaattcaagaccagcctgagcaacaaagagagagagagagagagagagagagagagagagagagagagagagagaaaggaagggagggagggggagagagagagagagagaaagaaaaataaattagccaggcatggtggcacaggcttggataattttttaaaaactatttgtatagaaggggtcccactatgttgtccaggctggtcttgaattcctggcctcaaacaatcctcctaccttgacttcccaaagttctgggattacaggcgtgaagcctgcgtgtatcgattttctattgctgtgtaacaaacaaaacctccacagacctaggggctcatgacagcacctgtttattagctcacaattctctaagtcagaagtctaggcacatctgggttctctgcttgggatcccacaagtctgaaatcaaggtgttggccaggtgtgtcctcatatggaggcttgactagagaaagatcaacttccaagctccctctggatgttggaagaattcattttcttgtgaccatattagcaaggccctgttttctcactttctgttggcaggggaccactctcaactctcagcttgtagaggtccctcttgggtcctcctcttgtggccctctccacacatagcatttggtccttcatgggagcaccagctgctggaaaaaatgattctgttaggtaaaaatactatacatttttgaaacatgcaccaattatttagctctgtgattgtgggcaatttcttcaagcagcctgagcctcaatttccttatttgtaaagctgggaaaacaacgatgcccatcttggagggttacaggcacatagaaaaacaatcaataaatataagctgctgtttacatttgttctttttttaaaaatttttaaattttatttatttatttattttgagacagagtcttgctctgtcatccaggctggagtgcagtggcgtgatctcggctcactacaacctctgcctcccaggttcaagtgattgtcctgcctcagcctcccaagtagctgggattacaggtgcacaccaccacgcccagctaatttttgtgtttttagtagagacgggttttcaccatgttggccaggctagtctcgaactcctgaccccagggcatccactgcctcccaaagtgctgggattccaggtttgagccaccacaccaagcctacattagttctaacgaatagacagggtctagacacagtgagattagatgagtgagggacagggttccctacatggagaaaactgcaagagccaaatcttggaagcaggaaagctggtggtttatttgtgaagggtgtgtgtgtgcgtgtgtacagagaacgctgaaagagtaggtgaacacagttttgcttatccctccagtcagaatttactggatgcttactgtgtacccagtaccatgaaagggtgcccggccagcagtgtgaattcagcctggaagtgggagggagccaaggaagagctctgagttggagagggaagtggtctaagcttcgggaaatttatctgctcctagtagagtggttgactcagcaggagagaacccccttctcttctgcaccctctcctccctagcctcaaagcctgctaaggacccagttcccaagcagagacccaggagggagttgcagaatctggccctgtctggacaagacagacagggtgcgactccagatgccagttcctttctttctgctcctgaatggccccaaagctatcccttctcaccacaatggtcaaggagggatacagcaatttctcttttaaatgttacacatagggctgggcacggtggcctctaatcccagcacttcaggaggccgaggtaggaggattgcttgagcccaggagttggagaccagcctgggcaacataggaagacccctgtctctaaaaaaaaaattagaaaaataaagttctaaatgtgggaaatcatgctgggcactcaactacagcagctcacttgggtacttgtccacactcacaaatatagccctgggaccccaaagtcactgtcccaccctcacaccatgggcagatggactcaaactaagccaggcttttggctttctgccacttgcctcttctctctgaagtgaatcctgtcctgatcatcacctccttgctgacagggccattaagcgcagttcacacaaacaaaccacgatgccttgaggttgagactgggaggtatgttaagggagcatggagccagccattctgcagatggggaaactgaggcaaagaaaaaggaagtgacttgcccaggctcaggcagtgagcccaggacagaccaagactgaaatctgacaatcagcccagggtttatacacacacacacacacacacacacacacacacaccccacaatttgagttacgctcaaattcagacatcgtgggttgaacaacaaagctttttttttttttttttttttttttttttgccagagtcttgctctgttgcccaggctggagtgcagtggtgcgatctcagcttactgcaacctccacctcttgggttcaagtgattcgcctgcctcagcctcccgagtagctgggattaaaagcacctgccatcactcctggctaatttttgtatttttagtttcaccatgttggccaagctggtcttgaactcctgagctcaagttgtgtgccggccttagcctcccaaagtgctggcattacaggtgtaagccaccacacctgggccacaacaaagctttttgaatagaagttcttggaatatggcctcttgttaatgtgtaggcccatctgttgggggaatttggggattatgcctgctctagctggctttaccaattaaatgttttcccctctctgtctcagttttttcaccggtaagataggaagaatttattatctatgtcagagggattcctctcagcctcactctctatctcaggtcggggggcaggggagggtggggaaggaaaggagtggtgggccagtcctccagctaagcacacagactggcccatacctgcaagtacacacaaggtcccttgagcgacacacccaggctgacacatcactttaagggggcacggaggggggcaggcagtgggagtggcaagccagtggggagcccccaggtgagggcaagcccgaggaatagaagggtggcctctttttttttatttttgtttttgagatggagtcttgctctgttgcacaggctggagttcagtggcgtgatctctgctcactggcaacctctgccgcccggattcaagcaattctcctgcctcagcctcccaagtagctgggaccacaagtgcatgccaccacgcctggctagttttttggtattttttagtagagacagggtttcactatgttggccaggctggtctcgaactcctgacctcaggtgatctgcctggctcggcctcccaaagtgctgggattataggcgtgagccactgcgcccggcctgaagggtggcctcttgacctccagtcctgcagcccatgaaattgggcaggtactcacacctgggcatgggttagatgggcgtgggtccctagtaactctgagtatgagctcatgtgcatgtgtgtatatgtttatatatggatgccttcattgtatgcacagatacccatgattatccatgtgtgtgcataggaatggcaccctctgtctgattggaaatgagactccagagttaccccagcatgatgttcactgccttttttttttttttttttttttttttttgagacagtgtctccctatgttgcctaggctgaagtgcaaccacccaggctcaattgatcctcccacctcagcctcctgagtagctgggtcttcaggtgcaggccaccacacctagctaatttttgtatttttaatagagacaggattttgccatgttggccaggctggtatcgaactcctgggcttaagcaatcctcctgccttggcctcccaaagtgctatgattactggcctgcactgccgcgcccagctctgctgcctctttttacagcctgccggcccagaccagagtctcagaatactaagcccactttctggggccagggtcagtagatagctttgctgctgtatgattctaagcaagtatcttgacctgcatgtgtctcagtgcacctcagtttcctcacctataaaatgaggggtttggatgagttgaggtctgaagcctcctccagcccaggtaataaatctttgtagtggacaggaggaataggtcctaggggtttcaggaggggacttccatgggtacctctgactctacagagaaatggaagactgagatctgacttagcagcctagaaagacttagcagcctagaaatggggttcagctaattctgggaacagagtccggtcacttaaggtaccagagtgtagccaagagcccccttttctgggcttggggaaccagaaccatgtgttcaacagaccattgcctgtacacagggtagagagtgcaggtgtatactcctgaaccagccacccttcttttttttttttttttttttttgagatggagtctcactctgtcgcccaggctggagtgcagtggcacgatctctgctcactgcaagctccgcctccccggttcacgccattctcctgcctcagcctcccgagtagctgggactacaggcgcccgccaccacgcctggctaattttttgtatttttagtagaggcggggtttcaccgtgttagccagaatggtttcaatctcctgacctcgtgatccgcccgcctcagcctcccaaagtgctgggattacaggcgtgagccaccgtgcccagcccccagccacccttcttaagcttcaagctataactactgagcctgtgatgaaagtctactctatgccagacccccacaagctgggtgcgggcagtatagggacaaagactctgcccttgggatgccaaccatccacttgagaagacacatacacatacaatgagtcatcatcacttactgtttatggacaaataaacgtccatcaaggtagccatcaactcgtgggtagggacaaggaaggctacctagaggaagaaagggtgagtagaatctctccctctctctctcttttttaagagacagggtctggctctgtcatccaagctggaatgcagtggcttgatcatagctcattgtaacctaaacccaagtgatcttcttatttcagcctccctaagcagctgggactacaggtgcatggcatctggctaattttctcattttttgcagataagtggtctcgctatattggccaggctggtctcaaactcctggccccaagcaatcctcctgccttggcctcccaaagtgctgggattatggctgtgagccaccacacctggccaagtagaatcttgaagacaggaaagatctggatttcagaaagttctgaagaaggcattccaggcaggggaaacagcttgagcaaaagggtggaggtgggagagtgctgtagagtcaacaaggagtttgactttagcacaagatgcgtgtaggagaaggggaggtgaagctggagagaactggggccggagcatggggggcatgagttctgtgttaggagtgtggggctttaggagccacatcaggttttagaacaaacaagtggcttgacaggagagacgtgttagggattatttaattaaagtcagcaagtaggtctgaaagggtatgaggttagcaggaagtggctgtgatgggcagaggctcagagttgcatggaatgaggacactttgggtataacactccaagggccacaatgccactcccctctccacccctcagccttgggttatttttttctggcttcttcccctgtcgctagggttaaggagtcccttgggggtttcagatgaggctgggatagagttttatcactagagtgccgggcacggtggctcacgcctgtaatcccagcactttgggaggccgaggcaggcagatcacaaggtcaggagaccgagaccatcctggctaacactaaacatacaaaaatacaaaaaatacaaaaaattagccgggcgtggtagcgggcgcctgtagtcccagctactcgggaggctgaggcaggagaatggcgtgaacccggaaggcggagcttgcagtgagccgagatcgtgccactgcactgcagcctgggcaacaagagcgagactccgtctcaaaaaaaaaaaaaaagttttatcactagatcattaacctctggcctaggtcacctccggcctccttttgggctaggtgggcagttctcggaccctcccccaccagccctgctctgctgacctagaacctctggccctggagattctgatatgtgtatttgtggtctcttctcgggcatctcccaggccactgggagagctggggcctagagcgtggggtgggtggaatcctgagggcagagagtgtggaagaatcttacaatggcagctctagagggaagcctggatatgtttgtttgacaaactgagacccagagaggtaacatgacttgaggtcacacagcaagtctagggcacagtcaggactgaaagccaggactctggggaggctaaagcgccctgaggtttagaccatctggttcatgtagagaatggagagggtcagggctgggagctatgggttcaaatcctggctctgccattgactgtacttttgtgacctaagaaagtcacttgagctctctgagtctgtttcctcaactgttaaacgggacaatatctaccttttgggttgttgtgaagataaaaaaacacacccatagcacaggtcgtggcacacagtaagtgtgccaatacatgtcagctagtggtatggtggtgcaatagtaggtgcctaataaatgttgaatgcattgttgaacatgagttcacacgctaacagtgagattgtgagactcagctttcccacgtgtaaatcaggactcataatcagtccctgtcctgccacttctttacagccccggtagcaacatagattaaataaggtatgtaaacgttcaagcgcggagccgtctcaggtcaatgtttactcagcccagggcaattcctctccaagtcctactctgcgaaatttcacgtcagcttcactaacttctctacattcccagatgctccccgggaaccgggggttggggatgtccctcttttctcaagcccgccgagctgaggaaaaacggggtgggaaagcagagtgtgtaaggctgaggaggtgagccagaggggggagggagagcaggaataagggcagtggggagaatgcaggtgcacggacgtggtgtgggtcgagaacagggtccgcatcgggggacttggatataggatgcagtgaaaggatttggggagcagtgggagaggtgagggcgctgcgatccgggaagaatcaggaaaataaggagccggtaggagggagtggagatcctcctcgcggagagctcgccgcggcgcagggctcccagctccccgcagctgcctccccgaacactcaccctcccggttccgagaacgtttcccggcccgagcgcccggcccgcaaaccgggaggggaggggaggggaggggcagggggggatccgcagcccgggattggccgccgccccgccagccggtgacgcgaggcgggcgggcccctttgtgacgtcacaatcagctgtttgaacgttccaatttgtgccgtgagccccgccgcagcggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtgagtcccgacccgggtgggcctgggggctcccctgccacggacacgccctgcgccccccgcgcccgggcctttgtctgtctccgccggcggccgccggggccgcgttcccggctcccgattggttgccgcacgcccggtagaccatgacgtcgttctatttgcatatgacattgagacgtcaccaaggccggtaccgcccccacaggctcgggtcgcttgtcctcccgtgacccggtagccgctgtgtcggggctgggccctgggtgagacgctgcaatccaaagggggctgcagggggatcggcgatttcctaggcttatccaggggctggggtcaggcctctgatcccctactttctctttgcaacctgagaaggagtcagacggcgctgctgggcctaggttgagggggtcgtcaggagttcagggctgcatgggactccaggtggttgggacagcaccagatggtggtgggatcccctccctccggctccagactccgcccccagggactaacagaataacatcctcctaatccctgatttgtgtgcagcgccttagctgatgtcactcctagacccaaaatgaagggtcttagaccccagtgcatggaaggggcaacaggcccagagaggaggattagctctctcgaggtcacataaccaattagagtcatgctcactgagtgacagatggattattagccaggggcaaagacataataggggctcagtacaagtggtaagatacacatcctccttccactggggacccgatcttgggctcagccttatcacggtttgataggctcctaggtgtccttactcctggacccttttccagggaatctctggagattggttcaccttttgtggtcctgaccccttctgtcctcactgtaccttgaagtcctagagtccaataaaatcgctgcctcccagctgtttggatcacagagaggtgagtcattggctgcctcggggtgtctccagggctgatgttggggtggagggtggggtgagggttccctctattggccctttaccttcccaacttcctaggtcgtcagctaggaagggcctgacctggcctagtgcagacaattgcaggtgttttgctgctccctcgtcacctctgcccacagagagtataggagaagggataggataaggagagtttctgacttaacaagtggatgggcctagaggctgaaccaggaactccattcctgctgggagtttgctcaaggatgggctgggggtaggggtggcttagggcacaaatgctattctgggcagagctgctgtagttattaaagggaatggttctccctggagcagaactgggaatgtgagaaccaggaagctggcagggctgggaaaggaaatctgggaggctccccaagtggtcaggagagggggcaggcactggctggctggtgactgctttcactcctggctgtcactgacttgctgtgtgacctcaggcagggagcttttcccctgagcctccctcccctaaacctatctgaaatttggggaggcacagtgcaggctctggtacacagtgggtcttcagtaaatgcatgctaaatcttggtgccagtaaccccagacccttttgtagctaggcgaggggtggtgtggctaggtcaaggtctttttcacctccctgtacccctgcatcattgtattcttggggattgtttgctgagtctttcctgactgtgtacactctggactggatgcacagtaacgtgggactaggtctgccctgccactatctagccatgtatttttggatagatttatgtcttctttctgatcatcagattttaaaatgggctgggtgaatatgatggtccctgaaacagctcttaacttctctttcatattccatgaattagtaggttcttggaaggaggatgtgcctcatcaaggcctcgatattcccttccttcaagaggggccaaactttctgggcttttggtaatggagtcactagctccctgtggctacatatgggttgggatacatgaattgtgctgggtggacactagttgggggtggccccaccttcttaatccctgtagatctcccacccccatcccaccagagaagccagcatcttaagcctactgtgagtctgcagatgtggaaatattctcagggtatggaagtgaggtgattctgcagcaagtgtgaaaacatttctagggaatgggggaggtagcaataagcatggcaatactgcaggtggattagcagaaagaggagaaatgccttcagggaagtctggacatgcccccaggaagttctacaggaagtgtggaaacacccttagagaatggtgacaagtgtctcagcagcaaaaccgttgagcatctttagggaacaggtgtggagagtcagtcaggcttcaggtactgggggagtatggccagcagcccccagccaagctctagtcctgaggtaggctggcatggggagggggtagatctagagctaccaccttggtgtttccatttctgcagtagggggcctccctcttcatcttcacccagggaaggattggttaagggcttacctcggtctgggtccaaccctcagtgctcatccttaagggctcctgggaactgacagctccctcccttcatcatcacctcccactgacctgctgtctcactgagcccaagcaacctgatcttcctcctacccctggatgctgcccttgaacaggagcctgggaaaagggggtcagaggggggagggcctgccggcatgccatctttacacttcatatgacagacacaaccgaggtgtgccaaatcacatggtaagatggtagcagttctatgggatttctgctggccagtgcttttcaaaccacacaggctccaggagtggttcttaatctctggggtcaaagattgctgtttaggaaatcatgatgaaaaccaaggtcctttttcccagaaaaatacacatggaccatgacccctggccaccaaattgaaaatatcaaattcagacagacacccagaaaaggcaatagaatatagtgattctgggtgctgcctctggaatctgattgtgtggattcaatcccacctttgtctcctactagctctgagactttgggacagttaacttctctgagcctcaatttcttaactgtaaagtaaggacagtaattatccacttcctgtagttgttgtgaggattacatgaggtaatataggtaaagctgcttagcatagtgcctggaacataaatgttagctatatcattattattattttgagaccaagtttcgctctgtcacccaggctggagtgcagtggcacctcgcaggttccagtgattctcctgcctcagcctgggattacaggcacctgccaccacgcccagctaatttttgtattattagtagagatggggttcaccacgttggccaggctggtcttgaactcctggcctcaagtgattcacccacttctgcctcccaaagtgctgggattacaggcgtgagccactgtgcccggcctagctatattataatgataacaagcagacaatatgggcaatttcctccctgcctggagaactcctatttactcctcagagtgcagcttggatgtccaattctctggagaccttccctggcagagctgtgtcatgtgtcactctatgttcctaaagcaccctgtaataataactaatttattagtttgttgagtgcttaccatatgcccagacagttctaagcactttataagtgtttagctcatttaattcttcctcctccatctttttttctcattcaataactttggtatagctcatttaattcttattagagcctggaggaggatactattattagcttatttaattcttataagagcccggaggaaggtactattatcattgtcttttgacagatgagaaaactaaggcacagataagttaaataactttctaaaatcatacagaagataaaaaaaaaaccctggatttgaatgcagaaagcacatcttcccaaagcgtccgcacacatccccgttgtgtgtacccttctccctgctctgggggtgatatcttctggcctcttccccaggccaggagtggggtgaacctcaatcagtggtggctctcacgtccttctgattcccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccgggtgaggcctgggtctgtctcctgggcctgtgaagtcattctaagggcagatggcctagcagcggaggggaagggcgctgctgggggacgggggagtcccccaagcctactggaggtggggtcacggggccccttcccatgaaagccggggctctctcctggcggcccaggagaggcccgcacgtcaggtcccctagggcagcagggcgagacgcctggcccgtgggtgccccggggcgctgcggacgggctgcgggtctgactaacgatgccctttctctccccgcccccttgtccggtgtgtgtgtgtgtgtgtgtgtgtgcctcctcgctgctcccctcctctgcacggctcccatcccgcgccccgtagacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaagggtgagcgggccgggggcggagcctggaggcccagggagacggatcttggaggccagggtccaggctaggaggctggggtagtggggccaggagcccgccccgcgctcgagggggtagcggccttgggagggttgcctttgagacaaagtggggggccggtgggcctccgggcgaggctagaagcgggcctgaggacggaggggcggggcttgagagggaggggcgtggccaagaggctggggccggggttggaggcttgaggagcgtggctggagcgcctagggagtgggacttaaacagaaaggcaagggtggaatagggggtgggggtccagtctcccccgaggtccagtttacctgttaagggctagaaccgaggaggcacctccgggttggtacccacaagaagggcgtcgggcaccccaatctgaacagacacagaactgagccgaagcaagggtgggagatggcagcgccctctagaccccccgcccagcttacccggcttgaccgagcctggctctgtcctcacagggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatgatcctttctgcctgagttgagcttaagtatgagaagcatcttgtaatcttaagcacagtagtggcataggatattatgataaagctggccttggttctggtgtgtgtgtcatatgggagaggaagaggggagataagcttactgggaacagagccagacaatggggtctgactcataaatgactactgttagaggatccttacaatgcaagacacatacatgaagacagctgaaatagagatgagaataacagcatgacagaatgaccaaactcatccttgtggtctcaggcactgggttagagcaagggcaagtagccactggaggggaaaggatgaagtctaatcctgggggagatgcagcagaaggctgaagcccaggctgagacaaggccagggccccaagcatcagagtctcctcaagttgcaggtagggtggggcagaagcagctggctttggagactacacacattttgaagaaggacagccagagtgaaatgtagtggacatctctgaaatatacagcacaaaatgacccctttaatttgggagctgctctgtctaaccacagaactaaaggtggaaacctgacctaaactggactagatttttttttttttgagacggagtttcactcattgcccaggctggagtgcaatagcgcaatctcggctcaccgcaacctccgcctactgggttctagcgattctcctgcctcagcctccccagtagctgggattacacgtgccaccatgcccagctaattttgtatttttagtagagacagggtttctccatgttggtcaggctggtctcggactcccaacctcaggtgatccacccgcctaggccctccaaagtgctgggattacaggtgtaagccaccatgcccggccctggactagattcttgatgctggcacaatcttacaggccagtttgggcttacctcctgcaaggaggagatgtcagcacaattgttttggagcaatccaccatgcaaatggaggagcagatatgtgacatggtgaaaaagtgccatctcagctgctgacagcttcctgtccctagaaaatcctgggtggccattgatctctaagttggttttgttatttgcatcaaaagaaatctgagcaatatatatcaaaatacctggcacagtgctgaacagggctagtttcttcaaagccaagaatgaggtgagggagcaagtatgtacattttcctcaacttgccaggcgggcatctcaggttcaatgaggactagataggaattccatccacaaggctgtgtctgcttagttaaggtccaaagaaagagctgatcacccaaaaatcccttaccaataacataactttatgttctatgacaatgacatttatttaacacgttatttcacattgtacaaatccttagattctctttattcactggtccatttctacaacaaatacatccaaaacactatataataaaattatttacaacatttccaaatgagaagattgcttttgcccccactactgctattcacacacagtacttccacggcacaatacatcattaggagatctaaaaatgctcaccctgtactctaggctgcttaggaaatgtgaaaactagtaacatttataatggcattagctcctttcaatacaagacaacattttagaaaccttgaacttcaactcgcaacaccaaaagggctcaacagtcctgctttccccattgcactttatgaaacaggttgcagggactaggaaaagggccacattattaaaattactaactgtacagaaattgatttaaaaaagtcacagctcaaaattgctctttgtaaaagtcacacacatttccaagtatcaagtcgcagtcctgcttgtttacttggattttcttcgcttggattgcaccgcactggttatgtctgtgggggaaagaaaggacatgttcagtggaagtaactctttacagcagtgccctttagacagtccacaacaagcagggcagacctaaggggagccctactcaactcagaatctgtctaaggggtgctctgaatggagagagtcacaggctttgcttgatgacttacgtgggaagagggtgtggtcctgcattgggcagaattggaatgtgacagaggtggtggcgatgaagcacactgactagagaaagtgcagggtggagagagcctttgtagctgggcaattcacccactgtttccctcaccagttctcatcataaaacgaagtgtaatagacagactgacaatgcttttggtgagaaatcaacgagtaatgccataagcaaatgagtaaattctgttagaatgcaaaaaaaaacctgccttgggatcccttttggagccaagctattgtttcacagtaaggaaccatttttgtcatgctatagtcaaggtctaaacaacatgaccatgggccttggtcagtgagggtctactatggcccagccagttatatcaagattgtggaaggctgggcgtggtggctcacgcctgtaatcccagcattttgggaggccgaggtgggcggattgcctgaggtgaggagtttgagactagtttggccaacatggcgaaaccccatctctactaaaaatacacgaaaaactagccgggcgtggtggcgtgtgccttaatcccagctactcaggaggctgaggcaggggaattgcttgaactacggaggtgaaggttccagtaagccgatatcccaccactgtactgtagcctggagacagcgagactccgtctcaaaaaaaaaaaaaaaaaaaaagactgtggatacatacagtcatgaatgcaattcagaataagcaacggcctgctctgagcccaagtgagcctgaaggcttcatggaggaggtgggaactgagtgatttacacacagaatgacagtgacatacagggaaatgactatgttttgattcctttagtttctcttgtactatcagtgttttaacttaatcttatgccagacttaaactgtgtttcttaaaaacgttttggccaggtgtgatggctcacccctgtaatcccaacactttggaagactgacgcaggaagctcacttgagcccagaagttttgaggccagcctgggcaagatggtgagaacccatctctacaaaaagaaaagaattagctgggtgtggtggcacatgcctgtagtcccagctactcaggagaccaagtgggaggatcacttgagcccaggagttcatggctgaaggagttcaaggctgaagtgagctatgttcatgccactgtactccagcctgggtgacagagaccccatctctatttaaaaaaaaaaaaaaaattctacacaaagttatggcagagtacagtgaatagcctgaagctctccaaaggtaaacacttctttagaatctcatattgacttcaaaaggtcacctttatttcatattctggttttaatatgaaaataatgttctaaaattacttctcatcaaggagaaaaaaaatgcttctaatatatcaatacaaaagatgaatcagatttacccatttctggtaactaggctgaattttctgatactgcatgttaggttgtattcaaggcaaattttcctttgtcttttgtatcataatattttgtgaacccagactctaataaatatgtagattgtaaggaaaaatttcactactctgttagctaaggtgactgctaagaagtgaggcctaggccaggcgtggtggctcatgcttgtaatcccagcactttgggagtctgaggcgggtggatcacctgaggtcaagagttcaagagcagcctgaccaacgtggagaaaccccatctctactaaataaagaaaattagccaggtgtggtggtgcatgcctgtaatcccagttactcgggaggctaaggcaggagaattgcttgagcctgggaggtggaggttgtggtgagccgagattgcgccattgcactccagcttgggcaacaagattgagactccgtctcaaaaaaaataaaaaaataaaaagaagtgcggtctagatgaatttccaagaggtgcccagtacagtaatttcattcaagcctctgttggtggaaatttcagtatgtttgtcttctcaaaggtcatgtttttttttgtgccatgtggtagaatcagtctttctgatttactcattagtcttttactaatcagaagacagttaatctgccaggatgttaataatggtgttctttattttaattcatgtaaattaaagagtctcacacagcccacataactccctaaaatcaactcttcaggtccaaatctcaagcgttattttcactgcagcaaatttgtcatttgcagtaaaaataggcagggtttttgtcttgacagtgttcatcctcagcaaaacattcattaactaggtcaactttggaagcttttcccttgttgtgatatgaaggatcaagtggtatgtctgagaaacatatgtggctgggaaaagaagtgggtagtggggtgtgggggagaagcaacctcaggctccccctccttccttgcttgttcccatttgtcactgctccgaagcacccaatgaactggtaggttgcctctgagcgtgaatcaatgagtggggtcaggaataaacaaatgacttgtgctagaaactgcaaaaaaacccacaaacacaccattaaaaaccctcatcttttggatactgtggttggtggggagaaggatgtaaactttcatacttccatgaggaaaaaaataaattttaaactgagtttgaagtctctatcaccttccctggataaatccagtcaatctgagacatagagcaaacctcagactcaacatgtctaaaaccaaacttgggattttcacctccaacagtgaggtcctttgccactgttccccatcatgtctgaaaaaaatctgtctgaaaaaaacatcttttgatgagtttttttgttttggtagttgattttctactccctccaaaatgttaccacttttactactctaatgaataggcaaatcacctttttttttttttgagatggagtcttgcaaattacttttttttttgagacagtctcggattgtcgcccaggctggagtgcagtggtgcgatctgaactcactgcaacctccaccccctgggttcaagcaattctcctgcctcagcctccctagtagctgggattacaggcatgcaccaccacgcccagctaatggttgtatttttagtagagatggggtttggccatgttggccaggctgatctcaaattcctcacctcaactgatctgcccgcctcagcctcccagaacgttaggattacagaagtgagccactgagcctggccacaaattactttaaggtaagaaattctaggtaagtgatgtagaggctaatgatccagtcagggtgtacctcagactgtgattggcacgctgttcctaaaggctgcctggcctgactgtgaacctaccttcagttttttaactatcagggattttacaaaattagtgtctcttaacagatagacaaatagttcaaactctagcagtgtagtcaaatcatttatatccatgtcttagaaccaactgggtggtaaagaactgggtcaataatagtcttttaagtgactgtccaactatgtcactgggggaacatttaaatttataacctaataaagggatttgtttttcagcctggttgcctcattttgaccttaagcaaatttgaccaaatctacagtacaaggctctacttaatcctctagtatgtgacctctaccatccaaggagctttagaaatggactttgaccttgctcacatcattgtgcctttcactgtactatttctatccgagacgtctaagtaattgtaaaaaattctggaaatcggcgagatgcggtggctcacacctgtaatcccagaactttgattagcagaggtcggcagatcacttgaggtcaggagttcaagaccagcctggccaacaaggcgaaaccccatctcttctaaaaatacaaaaattagccgggagtggtggtgcatgcctgtagtcccagctattcgggaggctgagccaggagaatcacttgaacccaggaggcagaggttgcagtgagttcagatcgcaccactgcactccagcctgggcgacaatccgagactgtctcaaaaaaaaaagtaatttgcaagactccatctcaaaaaaaaaaaaaggtgatttgcctattcattagagtagtaaaagtggtaacattttggagggagctctccagcctgggtgacagagcaagactctgtctcaaaacaaacaaaaacattctggaaattttccttcacaatttgcatggttggtttcaaaatgaagctactacagtttcaggtggttactcttcagggttttctcccacgacattataaatgtatgttcacttgcatatctacagtaatacttctgttttaattcagtatatctttataccctgtgtttttttagacagtttcttcactggctgtgggtagggtggggctatcacctactttgttgtcagagggacacccagggctgctgataattacagattgctctgaactttccttaaattaacatattttcctggttccaaacttaaagctttgaacttcatatttttaactaccttttaaaaaaataattacctttttcccagttgaaaatataacaacaactattctaaatggaggagtaaataatgataaagcaagctagaaaaatcatttgtgtttttgtggcaaattcatcatgtcaggaaggaaaactactcatttgcatgtttgtaaacaacacatctgatcaggtgcaattttaaaaagtgatttgtggtagctaatttttgtgtaattataagtgacccaaccaacaaaaacaatggaccaaagaatgaccaaaaaccatgtgggccttcctggacttgcccagaaatcatccatcccacctgctctgatctggcagtctggcaggccttggccagcatgatgtaagcaaactcggctctcgcagcaggagcatgattaatgtcactggttctccaacaatacaaacagcaacacttttaattacaaactgctcatagtgtttctcagcttcagagattttcatgaaaaacacagaatgtctctgattttgtttgcatatgatatatatgaccaaactcttattaaatgcaaaaagaagccctctttccccctcaaaactttacacagtgctgattctgcaggaagatacttcactcatatttcaggtacccagcactgcatatgtccccacatttgaggtgcatccattttagaaaccagcttgatatttggtgatcacattctgggtatgggtttaaatacaatcacagtaaattattttataacttggttcacatttttggatacaatatacaggccaaaaatatgcataattattctttaatttggctccaagagctttaatactgaaaaaccaaaagagctacagtactcatttctgatttaaaaggtaactgtgatactacaatatatattttttggtttttgtcccacgttcctggctcacagctcctataactcttgtaatttcctaagtgagccatcttttgttaaaatatttggccttttgcccatggttcctgaaacagctctgaggttgagttgatcacaaatggccaactcttttatcaatcatgcctatgtaatgaagccccactaaaaacccaaaagggacctatctccccttccccttcttcctctatacaaaaaaaaaaaaaaaaaaaaaaaaaaaaacaacccgcaaaacccacaaaaggactgaattcaggggcttcccagaaggtgaacgagaacacatctacctgctaagagggtggtgcaccaactccacagggatggaagcttctacacttgggatccatccagaccttgccctatgtatctcttcatctggctgttcatttctatcctttaaaagtggtccccaacctttttggcatggactgggggttgcgggggagacagtttcaggatgaaactgttccacctcagattatcaggcattagttagattcttataaggactacacaacctagatctctcgcatgcacagtttacagtagggttcacactcctatgagaatctaatgtcacctctgatttgacaggagatggagctcaggcagtaatgctcgcttgcccaccactcacctcctgctgtgcggcccagttcctaacaggccacagaccactaccaaccagtccatggcccggggattggggaccactgctttaaaatatcagggcatagtggctcacgcctgtaatcccagcactttgggaggcgaaggtgggaggatcacttgagcccaggagttctagaccagcctgggcaacatggtgagtcctgtttctacaaaaaataaagaatttagctagccatggtcatatgtgcctgcagtctcaattactcaggaggctaaggcaggaggcttgcttgagcccaagagtttgaggctgcagtgagtgatgatagtgccattgcactctagcctgggtgacacagtgagaccctgtctcaaaaaaaaaaaaaaaaaaaaaaaaaaaaagcaaaagaaaaagccggctgggcatggtggctcatgcctgtaatcccagcactttgggaggccgaggcaggtggatcatttgaggttaggagttcgagaccagcctggccaacatggtgaaaccctatctctactaaaaatataaaaattagctgggtgtggtggtacgcgcctgtaatcccagctacttgggaggctgaggcacaagaattgcttgaacctgggaggcggaggttgcaacgagccaagatcacaccattgcactccagcctgggcgatggagtgagactccgtctaaaaataaataaataaataaataaaataaaagtaaaaattaaaaaaaaactttcatatgggaggccaatgtgggaggatcacttgaggctaggagctcaagatcagcctgggcacacagggagaccccatctctacaaaaaaattaaaaaattagccaggcatggtgatgcacacctgtagttccagctacttgggaagctgaggcagaaggatcatttaaactcaggagttcaaggttacagtgagccatgatcatgccactgtactctagcctgggtgacacagtaagaacctgtctcaaatgaaaaaaaaaaaaaaaaaaatgccaagcacagtggctcacaccagtaattccagcactttgggaggccgaggcaagtgaatcacttgaggtcaggacttcgagaccagcctggccaacatggtgaaaccccatctctactaaaaaaaatacacacacacccacacacacaaattagccaggaatggtggtgcaagcctctgtaatgccagcaacctgggatgttgaggcataagaattgcttgaacctgggaggtggaggttgcagtgagccgagattgtgccactgcactctggcctgggcgacagagtgagactttgtcacaaaacaaaacaaagcaagaaaaaacgaaagaaaaagctgtataataaactggtaaacatgtttccctgagttctatgagccactctagcaaattaactggacctggttacgaggggttcatggaaactccaatttttagccagctagtcagaagcacaggtaaaacaacctggggcttgcacctggcattggaagtgggcagcagtcttgtgggactgagccctcaaacctgtggatctgatactatctccaggcagatagtgtcagaattgaattggaggacacccagctggtgtctgaggcagaactgatgacttgcttgatgtgtggggaaaaaaacaccttacatcttgtgtcagaagcgtgttgtgagagtatagcaggagaaactgagtctgtttttctactcatacacagtaacttaaccagagacagttagagaatgatggcctgaggtcttgcgactgatgcggatatctatacatgactgtgattccagggacaggccagagctatgccattctttagggagacacttagcacccctccatgcaagatcacaaagcctgagagtcattatggcctcttctaagccaactgctaagcctcagagcaaggatgtgccaggctttccaacatcaccactgccacggtgggacaatgttcagtttaagtgtacaggcttattccccatccccaacaccccttaaaaacaggttctagctttccatctcttcttggctggtagttctctacagagcggttctagtttgagcatctcttcttaactgtcccagttgcttcttagattctttctggtgccctgtaaataaccctttagtaccttgaggctctgggctgaggtcaaggttccaaaaatctggtgtgtgacatctctaaaggccaataccttttccccgctttaaaggtaattacataccatattctatagcctagaagatcttactcttttgggaaagtgaaaggctacaagaacatgcagaactgaggggaagcagattttcccatagaactctaggcatgttcccttttatgctttaagtgtagtacttcaatatactgaaaagtgtactcccttccaaactagtttctgcctagagatgattcccagagaggaggaatgaagttattggcttcatatctccacctaaaatgaggatacctaagagaccctgactgtggtgtatacactattcctggaaaagaaagaaggcctctctcacctttgccccttaactctccagcaggctgagtatggtgatggtactttgtacacctcaattttaactgtatatgacctctggcctattcccagaggctcttgtgaggcatcgtgacattcttgcctagagacataacctgccaacagcagctgagtcctcagatccgtgtctagtgtctagtgtgggtgcaccagaatctgcctggtctttaggctggcatcccaatgatacttgaccgtttctcagcagtcctgctgataatcaggaactcagccaggatcccagctcttaccttacccaaactgaactactcaagctcagcacatttcctaagagaatgatctggtcactgcctcctcattcttcaggtctcagcttaaatgtcatgtcatttttttctagaaagccttctctgacctggcagaagagcaaggtatctcagctatatgctcttatagtgccatgtaattttgctatcatagcatttaacatttaacacagagtattagaattcgtctttcaatgtggtaaagacagagactttttttttttttttgagatggagtctcactctgttgcccaggctggaacacaatgacgcgatcttggctcactgcaacctccgcctcctggattcaagcaattctcctgcctcagtctcctgaatagctgggattacaggcgcccaccaccacacccagctaatttttgtattttaagtagagagggggtttcaccatgttggtcaggctggtctcgaactcctgacctcaggtgatttacctgcctcggcctcccaaagtgctgggattacaggcgtgagccactgcacgtggctgaggctctgtcttttcactattataacctcagggcctgacatgtagtaaatatttaatacatatttgatagatggttattcatttgataattactgattggtacatctctgtatttggcaccatactaggcaccagagatacagtagttcgcaaaatcagacataatctcctgccctaaccaagtatacatactaattacctatgtcacaaactggcatagttatagctgtggtattatgaagaagaacctggtgctgtgattccccatagcagtgacaactgagctaagataagtaggaagggtgggacgttaaggagaagagaggtgggcagagagaagagcactccctgcagtagctgcaacatatgcacaggcttgtgatcagaggaatgaggacggcatgtccgacttgctaagggaagtgggatgaggctgggagatgacagggccgagaccacacagaagcttgtggggtaggttgaagcttttggactttaatcctaattacaatggtaaatcattgaagggttttaagctagtgggtagtagtgaagatggaaaagggccacctgagataaaatgggcagttttttgtgacgagtttgatataagggtgagggagagaggtatcaaggaggacttgtctaatggatagatggtggtgccatttattgagatggggtacaatggcagaggacctcactgttggaggtgaaaaatcacaagtttggttttagatatgttgagtctgaggttccagtaaggatgtgcatgcagttgtctaagatctctaggggtctgtactagaaatagaaatacaaatttacaagtcatctgtgaaaggctgttactaaagaagaggggcatgactgagatccattagggagaaaatacgaatttgaagagaaaaggtgactcaggatcaaagtctgaggaaggtcaccatctaatggctgggaagggagactgaggaggagcagctggagaggtggtagcagaagacaacagagagttcttggtcacagaacccaagggaaaagttaatttaaaaaggagatagtagtcaacagagaacactcacagggtaaggttcttaagaaggtcagaggagatgggatcaaaggcatagatggagaaactggccttagacttgaggaaggacagctgctctattatagaaagcacaaaggaggatactggtagatttatttcttggtagtgggaagctgagggaattctattttctctgtgaagaggtcagggtctctaccaagagagagggggagaaagtgtggaccagaggtttaaaaagaatagagtgggaaagatagttgaccatggaaacatggaaagatagctgggccatattcaggacctatctgaagtgggtgatcatgaatttaaagtggaatcagctgggcgtggtggctcagcctgtaatcccagcactttaggaagctgagatgggcagatcacttgaggttaggagttcgagaccagcctggccaacatgatgaatccctgtctctactaaaaatagaaacattagccaggtgaggtggcacgcacctgtaatcccagctactcaggacgctgaggcaggagaatcacttgaacctgggaggcggaggttacagtaagctgagatcacgccactgcactccagcctgggcaacagaatgagactccatctcaaaaaaaaaaaaaaagtggactcaaggccaggtgtggtggctcatgcctgcaattccagctttggaaggctgaggcaggagaattacttgagcccaggaattcaaggctgcagtgagctgtgattgtgccactgcactccagcccaggcaataaagtgagaccctgtttcaaaaaaacaaacaaacaaaaaccaacaacaacaacaaaaaaacccaaaacccaaaaaccagtggaataaatctgccctgttatgttcttttttccagcagtgcttgttgctcttgagtacacacacagaaaacatacagttaaatgaacaaataaaggaaggaccaaacaggtagtagaagacaaagacacttgacagacttcaggaacagaagcaatgatgaaggacaaagtcttctactgctgtggtaagaactctattcctctatttgacccacaaatagcacccacatcccactgctaacctttagtagagctggaggctgaagcaggtcgagaagatcgtttacgatgtccattttccacactttcagaggccacagttggctcttcagttcgggagtttcttcggcctgggattttggacttttcaactatctctttgggctcactgctgacagagggaagcaaaaagtttccaagcaggtgagggaaccaggccacacaaaaaacgggctcttcagatagtttcattcgtaaagtaggagactaagaactatatagttattctggagagaaagcagttcaacctggggtaataagcactattgccttctatgttactgggggtttaaaagtgagtctagcttattacattagtaaaaataaaatagtaaagcataatgttggtgaaattgtagaaaaactggtaaaagacataaaaaaattggaacaaaactcccctaattcctcacccattttcttttcttttcttttttttttttttccagacagagtgtcactctgtcgcccaggctggagtgcagtggcgctgtctcagctcactgcgacccctgcctcctgggttcaggcaattcacctgcctcagcctcccgagtagctgggactacagccatgtgacaccacgccctgctaatttttgtctttttagtagagatgggggtttcaccacactggccaggatggtcttaaactcctgacctcaagtgatccacccacctcggcctcccaaagtgctgggattacaggcgtgagccattgcaccaggcccctcacccattttcctaaggtaatagttcccttcaaaaattaaaacattttggattttgtaattttttagaatcatgaaaatggtctttaagatgtctgaaaattgctattaactcaaaatagtatataaacctaggaaattattaacatatattggcatttactaatgatcccggtagagtcagataacagcatattagaagccacagtatggggataattcacaatacactgctaggtatattgattgtccacaccccaacccccttttcttagtatatgaagatttaaaattggtaatattcactgttattgaggatacaggaacaaaaacatttacatacactcctaactggagtgtaaattgtataacccagtggttcttaaaaggaggcaattttgcttcttaggggacatttagcaacatctggagacatttttgattgtcacaacttggggagaggggtgctaccggaatcttttgggtacaggccagggatgccactaaacgtaagccccacacaacaaacagttatctggccccaaaggtcaataatgttgaggctgagaaactctggtgtaacccttgactcagcaatcccacttctaggtgcctaaggaaacaaatctttttacagagctccacacataaggaagttaaaacattttatttgtactagtgaaaacagaagacctaaatacctaacgatagtagattagttagctaaatcatggcacatccatatggagtcatgaaaaatcatgttgtagattatttaatgacaaaacgatttatgacacattaccaagtgggaaaaacttaccaacacaatgaacagtataattccattttcattgttgtatgtgttgagtatatatgtaactacatatgaataaatatgagctatatacacataaatcttttgttgttgttgtttgtttttgagatggagtcttgctctgtgccccaggctggagtgcagtggcaggatctcagcaaagtgcaaactctgcctcctgtgttcaagcaattctcctgtctcagcctcctgagtagctgggattacaggcatgcgccaccacgcctggctaatttttgtatttttagtaaagatggggtttcaccatgttggccaggctggtctcgaactcctgacctcaaatgatccacctgccttggcctcccaaagtgctgggattacaggtgtgagccacaacgcccagccctatacacataaatctgacacaatatatttgggtgcacactgtgtgaaaaagactagaagcagatgaactaaaatatatgtacagtgaatattgttgagttgtaggaatactagtttactggtgagttattttcttctttgtaattctctgatctgaatttctggttttctttaataattttttacactttcatggttcaaaaacgcatgttaaaatgatcagaaaaaaaattctttagaaaattaaatttgcttgcaagacatgtaacaaataaaaataatgcaacaaaacaaaacaaaacaaaacaaaacaaaacaaaacaatactggtcaaaaggctgcctcttctgggaagtcttccatgatctcatttcccaagtagagctgtctcttttgtctcttgggttcacagtctttatctggcattctagagcacccatcagattgtacatcgtgttctattttaatgttttgtgtcttcaactagactgtgaacctcttaaggacacagaccataacctgactgtcaactatccctacccttccactgttcactcctgccagaggaccctttgctagtagcaccgtggttgggaactgggacacaccattcactcccatagctttatgtataacagccgcccgacacccaaccataagccaaggtaagtcaaggagaggtgaggctggagctggggtggaattacaagtcagggggatttatacctcctttgagaggtggtgaagatggctttctggctaggagctcagaaaatggtcaaagcttctgaggaaagaaagttctttttttaaaaaaaatttttgttttttttttgagacaggatgtcactctgtcccccaggctggggtgtgggtagtgcaatcatggctcattgcagccctgacctcccaggctcaagtgatcctcccaccttagcctcctgagtagctgggactacaggcaagtgccaccatgaccagctaattttttattaattttttattttttatttttttttcatagagacagggtctccctatgttgcccaggctgggcaactcctaagctcaagcaatcctccctccttggtctcccaaaatgctggggttacaggcatgagccactgtacctggctagatgattcctaatgaaagtgcctctttctcctggcaaaacaaaagccacagcaagactatcctgttttttatggtcaatgctcaggtatctctggaaacaaacaccccaaatgtatttttggtctgattagcttctttctctagacaaatagctggtgcatgcttgagaaatgcagatgaattcaaacattagcccaatccaaataaaatcagacaggcagagtggtatagtaggagtagcaatgaatttggaatgagatgaacaggggtgaagtcttagctatgcatttattgactatgctatttaatgctctatgttctagacttttttttttttttttttaagatagagtcttactctgttgctcatgttggagtgcagtgagcacgaccatggctcactgcaacctcgacctccctgggctcaggtgatcctcccacctcagcctcctaagtagctgggactacaggcacataccactatgcccagctaattttttgtatagacagggtttcactatgttacccaggctggtctcaaacacctgggctcaagccatctgcctacctcggcctcccagagtgttgggagtacaggtgtgagccactgagcccggccgttctagactcttttttcttttcttttcttttagacagaatttcactctgtcgcccaggctggggtgcagtggcatgatctcggctcactgcaacctccgcctcccaggtttaagtgactctcctgcctcagcctcccaagtagctgggattataggcatgcgccaccatgcctggctaatttttgtagttttagtagagacggggtcttaccattttggccagggtggtatcgaactcctgacctcaaatgatctgcctgcctcggcctcccaaagtgctgggattacaggcgtgagccactgcacccagcctcattctagattcttgatctataaatcccatcttgtctgttgcaatacataggttaaatatcagggctctgaagtcagaaggcttgggtttgaatctaaccttcaccatttactaattctgtgaccttgggcaatttagttaacctttctgaactttagatttctcatctataagacagaatttactttcctaatagatactgtgaaaattagatgagataacacatctagggcacttgtagctcaatctattaaggatgcatggcatggaacaacattcaaataaatggtggctattaacctcctcacagggatgatatgaagattaaatgaaaaaaatattgtgaaagtgtcttatgaagttgctgtacaattatgagaagttctttaaaatattatccagtgcattcctacactaaaagagacaagactgtgtgtggtggctcacacctgtaatcccagaggctgagacgggtggatcacttgaggtcaggagttcaagaccagcctggccaatgtggtgaaaccccgtctctactaaaaatacaaaaattagctaggtgtggtggtacatacctgtaatcccagctacttgtgaggctgaggcaggagaattgcatcaaccccagaggtggaggttgcagtgtgccgagatcgtgcaactgcacaccagcctgggtgatagagcaagactctgtctccaaaaaaaggcatgacttttggaaaatggtaatattcctctccacagagctaatgaagttgaagccatagatgtatgtcattttgtagggttatgtggagcagcacagtgtaacagaaaaaagcataggttttgggtcagatcctgcctggctttctccttcttttgctttcagggtcaaacaactgttctttagaagacagctgcaaggactattattaatattaatatcaatggtaacaacagctcccatatattgaacatttactatttcctcattatgcagaacatgttatctcactcagctttgaaaacaaccataaaaggtagaaacttggcctccagcttttattaagagaaatgttacctctgagggattaggactcatgacagctctctacgttagcagtaaaaacagactggtgcaagagtgaaggaaaaggacaaggtgaagagaggtttaaagactgagacagctgatacctttcaaagaggcttatgctgtgttcatgctacgtctgcagaaatgatcatcttacctttgtccagagactatggcagcatttacctccagctctgcaaaaaaatataaaggatagaaatgaaatgtgggagctgccacagagagaagctaggagtctacaagaattctctatgccctatttaggctaaagtgtccctgtgcccagcaggattctcaccctacatggtatggagacaaagctggcacagatacaacttggtttgtttgggacataagacacttggtctatttttatttctactccacatggtgaaataatctgtttggattaatagaactaagttcacccttccttgttcatatttcatccagttacaaccaggttagcaaaataagtctcttcctctcatgtggaagagaccgttttcattttaaaacatctccatccaccttgttgccacttttttaaaaaaagcaatcttcaaatatgtcttgaacatctattaaggatgcattcttctccaaaggacttcctcactgagttttagagggcacagtgctttgctttcagatattgcctttacaccccattctattcctttctttctcaacctcccagcaatgccctccaagcaaggaaaatcttagtaatctgtctagcagggttttccatcaatgagcacactctgggtttaccatgcacttcttcctcagcaccagcagaaaaacatttgctttctctattatgtgcctttaggtagttccatcttttccaaaagccttccctgatgtaccagatagcagtgatctatcctgcctctggcctcccacagccctattcctgttcccccattgagggaagtcagcacctcattactcagtgtacatgtctaacctactctactaatcacatggtaaccttaaaggcaatgaagtcagagtgcctggttcaaaattttgacttcaatgcttattagccatgtgaccttgggtaaattatctgacatctctgtgctcaatcccttacctaaaaaatgggaataatcacattacccacttcaaagttaaggagatgaaataatgcatgtagaaattttagtatggcacctgacacttagtcataactcaatgttattagctattattattgctatgaagatcagattgatgcagcctttcatgtaaggaggttggactactctgcctttaatgcaaggtgctagtagaagggaatctttgatgggaggctgaggcagaggaatcccttgaacccaggaggcagagacttcagtgaaccgagatcatgccactgcactccagcctggtgacagagcaagactctgtcccaaaaaaaaaaaaaaaaaaaaaaaaaaaaggaagggaatctttgcttctcattgctgtttagcctcctgtatttgtacccacaaagcctgaaaacccatccacaaaaaatagataccaattcactgagtctctgctactttgctggcttggctggaacgtataaactcaggtaatgtgtgctcaaaaatgaaaatgactcaagtcaaaagaagtgctcaccctcattgttttttatttttttgagacagggtctcactctgtcccccaggctggggtgcagtggcactcactgcaacccccacctccagggttcaagcgattctcctgccacagcctcccgagtagctgggagtataggcacgcggtaccaggccagctaatttttgtatttttagtagaaacagggtttcgccatgttggccaggcttgtcttgaactcctggcctcaagtgatctgcccgccttggcctcccaaagtcctgagattacaggcatgagccaccgcacctggcctatttttattttttgggggatggtctcactctgtctcccaggctggagtgcaatgggatcacagctcactgcagcctcaacctccttggggtcaggtgatcctcctacctcagcctcccaagtagtatgcatgccaagcccaactaatttttaaaaattttttgtagagatggggttttactatgttgcccaaggtagtcttgaacccctcggctcaatcaatcctcccatctcagcctcctaaagtgctggggttagaggcatgaaccattacacccggcctagtttgctcttcttttttttttgagacagagttttgctcttgttgcccagggtggagttcaatggcgcaatctccggctcaccgcaacctctgcgtcccaggttcaagcgattctcctgcctcagcctcccaagtagctgggattacaggcatgtgccacgacagccagctaattttgtatttgtagtttggggtttctccatgttggtctgggtggtctcaaactcccaacctcaggtgatctgaccgcctcggcctcccaaagtgctgggattacaggtgtgagccaccgcgcctggcctagtttgctcttttaaaacaagaaaaagtttgatgcttttgagaatcttaacactatcactgctgattcacaagtagagatcaagaaggtttgatgaaggtaatcagtggctctgagggatgttaaggataaggagattcatttacgccagacttccaaatggaagaggattcttcagccaattactgtgagaagggggaaaaatgatatggtaaatcctattttctagagtagggttggggcaggaaatggaattccctttccctttagagttactccttttcttaccaaaaatgagttttgctgtatgacccctcctttaaataacgtgctccattcctacccttctcaaatatccaacacaatgtcaggtatcatgtgggcaattggcagcaaagaaagaatctgggtggctgggccggaagtagtggctcatgcctgtaatcccagcactttgggaggacgaggcaggtggatcatgaggtcaggagatcgagaccatcctggctaacatggtgaaaccctgtctctacaaaatatacaaaaaattagccaggctggtggcgggcacctatagtcccagctacttgggaggctgaggcaggagaatggtgtgaacccaggaggcagagcttgcagtgagccgagattgcgccactgcactccagcctgcgtgacaaagcaaactccatctcaaaaaaaaaaaaagaaaaacaaaaagaaaaaaagactctaggtggctgaaatgttttttgctcgcacactattttcagaggcctgattttattcagagtgtgcagtagaaagtcctatcagtcacacaggatgtagcattctgaagtaggttttaaaataatcacaaactataccttacttttactggctcagattcacaaaattaagcatggctactattgctttttcttactaactttgtcaagtgtgtgaattgtagtttcaatgagattcttacctctgtggggaccagtcatacttttttttttttaactcctcaatgatctacagtgacaaagaatcaggcgaaactaaactgtaccatatctgcgatatttatctgcctccatagtctataaaggcaaaacaagggctgtggctgccatcatcctcatgtattctgagctgaccctgatcccacagcagttatttgtcagattaccatgggatcctacttccagaaatatcatcccttgtgctatttacaatatattggtcatggggagaaacttaatgccacccagagacgactgaaatgactctgcctccctggaggaatggctatcacattgtggcagagactcaatgaacaagactccactactgtcataataaaattacaaagtgcgttaatgcttgccagcccagtaagtcaccatatgccagctattcagctgccaaccatgggtgccagggtcacagaacagggaaaactctgcaacagaaacccatggctgggtggcagacagacaatgggcacggaattgcccttcttgagttccctagctgacactatgaatgcatgagagagcaagctggtcggggggaaaataatctcaagtagaactgcacaagctttgtcactcaaccaaagtctgctctgaagcaaacagataaaatagttcctgtcacttcctggcataagaacacacgacattgaggacagcagtagttccttcacatgtaacccatcccactccaagaagtttttccaaagtacgccttacctggtctggcaacagaggcctgcagtgctgtggttgaagtttcctttgagactaaattctgcgacggggctaaggcaaggaaaaaaaaattacagaccttttactttcttttctaaacaaaaagaaagcattaacctaatcaagggctaagtaactgctgaaacaatgtactcttagagggcagtactcaaaattggcctcgaaattacaagtacattttaaaacttactacaaaaattaattaccataacacccagtaccaatgactaccatttaggggtataggctcttcctttttgtatgtataataataaggggaagagatggctataagaacatagcactcacattttctgcttcttggggtcaggtcctgaccactacttgaaaaagccccaaagcatatcttagtaggcaacccaaaccatagaggtacaattataccattcccctcagcatttaaaaaatctagcctcactccctaaagactatactctatgagagtggaaatggtcacataattttgtacttttctatagcacttagcaaaagtgatgggcataaagcaggcattcaattcatacataataaataaataaatttgatatgttatttacttatctaacaaatagttgcaaagaacttactaggggcaaggcactgtgccaggtaccctgagagaccaaactatatcctcttgcacatcaggaactcagtctagtattaaagataagatatatacatgtagtgcacttgagtgcactctgatgtcatatgaaggagtcacaaagtataaaatactacaaaagtccaaagcaagagttagcaattctaggttgagaaatctgaaggtacattaaagggagaaacatcagaatcaggcttcaaaggacacagagaacttaggcccttaaggaatggaataaaatatgtaatgccctctagaagggaaccatcctggaagataaagattatggcatggatatgccacagtcacatcttgacatctcagtctaaaatcctagataaactctgcaacaacatgttttactctcttgtggaaactgaattttgtatatttccctccctgcttagcaaagcagtaaattatgcatttgtgtttaagaatttattttggatgcttatctgataaagcttaaaactatatcttaacttctacttttaactttagtgttcatttctcaaatttccttttctttttctcctgagacagagccttgctctgttgcccaggctgtagtgcaatggcaggatctcggttcaccacaacctccgcctcctgggctcaagcaatcctcccacctcagccttctgagtagctgggaccacaggtgcatgccaccatgcccagctaatttttacatattttttttgtagagacagggtttcgcctcattgcccggcatggtctcaaactcctgggctcaagtgatccaccagcctcggcctctcaacatgctgagattacaggcatgagccaccgtgcctggccaatttctcatattttcaaagtaaaagcacagaagccccttgaaaaagaacagaaacaatcacttataagcaaagtgagtgttcttaactaaaattgagaacttttcccaagtgctggttcatctcctcaaggcccacatatttctctagtataatatatgatccagataaaaataatttctaattacttcatcatttttctcttgataccagagggaaaagtctcctgaaagaaggagaaatggaaatacttaatagtgaaggatatacttaatttacaccaggttcccttttaattcttagggttcatctacaccaacagaactagaacaatatacaataagcacccagtcttgtgaagactgtctcttgtaagagcagcagacttcttgaaggcctttatcctgcccccatctctctaacactgaggtgaagaggcagagagaaggggaattaacctttccagagctctgcgtgaggcagtgtgttggccacttgacaaatcttctcattgagtcctctctcagaatcctaaattctgggaggtagaatgtacgatctccattttacaagtgaaatacatggcttaggagaggttaaggaacgtatcaactgtaactggtaaccagtgggctagaatttgaactctgatcttaccctgaagtttgtgttctttctgcctctcctcctgggtgcttaccactcagtggtaggcactcgaagcattttagctgcataaataagataggcacttaattagctggcctaggatatcgtaaaggtctttcccagctctagcagtgtgtgactgactccactctggggaaatagagcttcttcacttaagcctcacaggaggaggaacatgtcagggaagggaagaagggaaggaggggcggttgtaaggacacctatgcttccatcattagcccatcttaacagtacataggaaatagcctgaactagatacacaaatggaatgtaccaatcaacaaagagattacatcaaaaagaaactgggaataacaatttttaccatttattgaataataattatatgctaggttctgtgctaagaatgttatatgtactaccttattgaattcttacaactattattgttccatattacaaaggaggaaaccaaagtctggagtggtcaagtaacttgcccaagcccatatagctggtaaatgctggtgttataataccaacccaagcctactggctcttgaccactttgtttctactgtgtccattatcatgaaacccagttttcttccagctctcctctagagtagcccagacaaaaaaagaatggttcctgagatagagtacagtgagaatggggctatgaggacccattgttctgaaatagtcatgagcaaatcttcaccctggtaaagagaatctgcagaagctgctgttcacacttaaggcacagtgttaaatgggaggttcacagtatagactctgaacaaacactgaacgtctttgagcttcaatcttctcacccatacaatggggttaagaatatctgacatagttggtataaagatgatgcaagacaacatatgtaaaaatgcttccttataaattgaaaaacttatataaatgaaaggtatcattatttcaggaactctttgttttgagagccttagctctctgttttgtttttttcagacagagtctcgctctgttgcccaggctggagtgcagtggcatgatctcagctcactgcaacctctgctcccaggttcaagctattctcatgcctcagcctcctgagtagctgggattacaggtgtgtgccatcatgcctggctaatttttgaatttttagtacagatgcagtttcaccatgttggccaggctggtctcgaattcctgacctcaactgatccactcacctcggcctcccaaagtgctgggattacaggcgtgagccaccgcacctggcccttagctctctttaatgaatgcaaacttaacatgggatttaaaagcatattttccaacgtactttcaataaataaaactactgctattgccatttagcccattctctttcctccaagtaaaaaaggagtcatgctttctcttgtgggattaggtcatcaaaaaactgacacaaagagatgatgaagccccaagtacatacctatgctgggtagaagttctggatgggatcccaccttctcctccactaggccacccgcaagtgactcagatgctatgccaccatgattgctttttgtggtcggtacggcggagatgagctcggagggtaccagagtggttactatcgagcgtacactggtggggagagcaccgccaggtaagctgggtcctgctgaggcagtgcccgggcccacagggctagaggtcatttttagcagagtgggtgctgggggcgttggggttttactgtccagctctgtggataactgctctgttcccatgagccccggagctgtggtgtctagcccttggccttcagtctctccatctgcaccatattgttcttcccctttctcaagagagcctgtaactttcttacatgccttggtcaacaaaatttggccaattttgtccacttttcctttgcccttactagacgagactgggcttcgccggttgccagaggaccctggactattggtcaaaaggggagaaaccattgtggttgactgtgaagagggaagagtgttctgatctgctgaggtgttcacctgagggctagcctcatctggattcaattctttcacttgctgcacagggggatgagaagggacaactggagaagacgtacaaggaggggaaggaagctgaacaggggtggctcgtgagctaaggaccaaaggtcgacctgtctggatgtttggagcaggactactggagagggcattaggcggtacaggagcagaagaaaattttatgttctgaggtatgtgtaaagggccaacaactgcaacagagggaggcatcaggccagagttggttgtcagtggggctgcaggaattgtgcttggctgtgatcctttcataacctgaattattgaggatgaattgataaagacaggtgtaatgaactgaggccgggcattagactgagcagctgactgtccctcagaaaccataaccttgctacccgcattgggcattgtgacaactgttgacatcaatgcagactgcaagtgagttggcaaagctgctgatgtgttagctgaagttgtgatgggattggaagtgacaaatacagttatttgatttgggggcaagggagtggaaatggaggaagagctaacaggtcttgacattactggagggatgcttggtgcaacgttagaactgacctcactcaattcgggatgcacaagggatgaacacagctcattactgtgaggtaagtttagggaattagaaggttctttagaagaagacagatcctgcagtgtgggaatgacagatgcttttttgaggtcctccccagaaactactggaggtgttacttccagatctgtaagcccagggggtttaattgtcacattgggagctccagagttgtcaagaagttgacttaacgatgttggtgcttccctcatagcaggagacaccaaatttttgttctcttcgacactgggaagtttgttaggatccgaaggctgcccatcctttttggactgatcttcagggacaaccattttaacttcttgggcagggactgcttttagttcaatgtttacctgttccttcctactctgggaattctggcaatcactgtcctgaggcacattcaagctctccttgttatcctcaacaacacccccaactgcagccacagacacagtagaattctgaggattcagcccactgttgttaggaaagctcccaggtacagggggattggccagaggagtgggactgaccaatacatttctcggcaactccacattctgcaatagggctgcatttgtctgagaggccagagtaagtttaggggcttttgaattttgcctcccagggcttggagtggttttcctactggacccaggactagacctgcgactgttgcttggacttgcccgttttgttgctccagaattagactgctttccagaattcactaccacagaatctaatttgtgagtttgtggggtagcaaaattggaaggattcatggtaagatttgaaggtgcttgcccgatggccttcaaagttgttggatttaggccttgttgatcaaagcccctgtttaaatttggcctaggaggtaaaggaatattaatctgtggagggaagagtcctgctatggaggcattgagtctttctggtgacagactgatttctgaaggttctgtgctgggagggcggttgttgggtgtctgaggataatagggtctggggctggctctgtttggtgttttgggcctagatgtctgggttggcgcagccacatttgggaagtggtggccgtgagagctgggcagggaatttacagggggttgctggggagttgcaccttgagttgctgaaaggggcgatggtccaggttttggccctgtcatcattaactgattctggggaagtactacatgtgaaggcatgttgtttgggcctcctgggacagatggtgcttcactgccacttgcttcagggagtgaggccatctccgccagtggcgagctggaaggattctgcgggctctcctgatagaccattttccttgaattgcttcccaagggagtattcacaggcattggcattctttgtttatcaggtgatggtggcacggaggcaggtccttgcagactgaccatgacaggcacactgccactctgttgcatgggcattctctgggagtcggggttcagggggccccttggaggatggacattttgagagactggaagcctaactgatttgggatcctgctgcatcatgagcatcatcatcatttgttgctgctgctgctgctgctgctgagactgtggctgactgggaggtggtggctgctgctgctgaggcagttgtggctgtggctgctgctgtggtggctgtggtgggggtgccacatgctgcatgagttgaggaggcatctgctgaagtggcctctgttcaactggttgagaaggataacctaaaacaagccccccaaattagggaagttagatttttcagcaagaaaatgttgctacctttagagtatagccaagcaatactcatctaggtggcacagactatgcacaaacagctcaggcatgcccactcctggggcagggggcagcccctcattacttgacataagcaaaaggggcacagtgcttaaggaagcaaaaagcaaagcatcaaaaaacctggagctcctcggtgtgtaggatctgaatgagccatgactgtactaagagcctgattttctgtgctatgcactgaaaatggctgtgtctataccagccaaacattcagatgaaatgagaaaaactccatcaacatcaagtgcctggccacccaagattcaggtctcatgtagtcataatcaatatttcaatgtacttgtgaatgaagtaaagcatttaggattcacttcttctgttagcacaggaataatttttttaagatgtggttttgttgaaaataacagcactgaagacagcctttttattctttcaacagaagtaaaatataaaattctaggattcagttccttaagaaagaggaatttaaaattattccaattcattggctccatacactacgccgcatccttcaggcttaatcctttgggggaaaccgactgaattaaaattgcccttcaggtgtaaatcagtttaataaacagtaggagctaatggaagctgatatacacattgaaaataaaattagggcattgaagtttttatggatattaatttgcacttactttcttacatgcaaatctctatttggagaaatattttccatgaatccacagctggagaataagtaaggcagaagcatagccctcaggaataaaaaataattttgggaaaagaactctgaaggacaatgtcttctagatatgcagagggcaacatctcaaattattctctttttttgtgaagattttacttggcattttagaaccaaaaccttacaatcagaaaagataaaaagatacgcaaaccaagaataacggtggttctgtgggaaaaagtgggcatacagctgggcatatatgggatacaattccagttccacaaactagatttattccattgttgcatgaagagtacattagggaggttttaagaaggtgtaggaataagaacaactggctctggcagtcaaaagaaatgctgactcaacattttcatagagcagctaccaaattttgtgggtcagactcagcactcaattaatgtcttctggccaaagatttccatggtatcaatgaatacaatgtgtagaatccagttttgaagatttttaaaaaaatccttttttattttaggcccgagtaacttcttcacctttataaagccaataacatggcatttctatggttcaactgtcctttcgactacatagtcaaatacagtgggttcctatttttcacattcagtctggggttcccacattaagaaatttgtaattgctacaaaagcctgttgatgtcagggttatgacatggatgccttttatctttaaaatcagcccaccagacagtaaataccaaagaggacagcatagacaatatagcagcctctcaaaagtaacagttaagggcatggctgctacagagtccagaagctggaggcagcagtccaaaaggcactaatgataagacagattggggctgacgtgacagaatggtgaagagggaaagccaggacacacatagtgcccataacacaatcacaaactgaatttattactcagggaatgcaaactcctatgcctttaggggccaggcaggtagtagagaatagaagtggactggtataagacagcaggagtcctgtcaacagtgccaaactgcagagcagatgccctatttaaaggcatttaaactcggacttttgtttaagacactgcatagcaactcaaaaccattataggccaaattcagcctgcaggcccccagtttgcagaaagaaggcaataaatgtatacaaagacccctgggattcttataagaagagttcagatgtgtctgaggcaagcaggcatgttcctgctctcaatgccttctggacatactccccaaagactgatgacctcccagtctcagctatgctgctgcatctcactgacgggaagtgtgatatgcccaaataatttgtaataaataacacaaagtattgatatcatgatggatttagctttttgtttggattcaattttaaaatacataaattaggggtagattaaaggttactcctaaaataatgtcgctctcattttcatgccaaaaagaagttgaaataactagtgaggaagaaacaaaacataccctctgtacacacaggggagagtggcctaagtgtgaagggttgtgtatcttcaaccgtgtcataggggaataaagttacaagtcattgctcaggccaagataaccaggtatagagatattgtggcagctggccttggttctataatatctaggtttgaatgaattaattttaggagcttttccatctttgacataatttttcaacatttaaaggatagtattattttataatcagagaggatacaacaaagggggcttccaatattggtcctatttattataaattattaacctatgtggtagatacatgggtgtctcttttattctttatatcttctttatattttaaagactcattaatgaaacttctataaaaaagatcatcttgttttaaaccctggtagttccctgctttgagaagccccaggaagaaacgctgcaggaaaggcaggcaagcaggattagagtgaaatcatctctccatttaatcttatcctgttctgatgccaactagaatcttgacattgacaagaataaagaggcacttcacatttcatggtttttttttttttttttgagacagggtcccaggctggagtgcagtggcatgatcatggctcactgcaacttcgacttcctgggctcaggtgatgctcccacctcagcctcctgagtagctgggactataggtgcgtgtcaccacacctggctaatttttaaaaaatttttagtagagacaaggtttcaccatgttgcccaggctggtcttgaacacttgcgctcaagcgatctgctcatcttggcctcccaaagtgctgtgattacaggtggatgagccatcatgcccaaccacatttcagtccgattttatgaggacttaaaataacaaagacaaatttgaatagaatgtgtgtgtgtatgtgccttcaaaagttatatttgaaatttttacttaatatcaaggcaaagcttccaaataccagacacattaaatcactgaagtagactagttagcagataaaataaaatactattgtttccttgaagacatggaagccttgtaatgccacatgcacatgtaataagtatataatctagctaacattttatcacctggtggccggtttgaaaattctggcagtttagggcctgagttatccaagttaattccttgttctccaggcaacggtggctgatcagcctcttccagaccagctgggcgagtatctggggtgctaaaaaaaaaaaaaaaaaaaaaagtgacatattttagaataagttgtatagaaaatacacaaaactagcttaacccttcccctatttctgaagaactaaaatgtttgcattaccattattcatctctctctagtctagataaaatattaaatattggcataaaaataatctggcaatttcattaaatgttaaaatccatttaatctaacagcactgtatttactcagaatgctttccacaaattcctggtgcaataattttcatgtaatcacccattccttagctgttttaagacctgatcataggactatcaatgttacaaggtactgttcctgtgaaaccacactatcttcaatgtagcgatcaaattcaactagggggtctgattgtttcttttttgtggatataacagtgggggctcaattcataacaccttgcaaaaggttgtataggttggctgatggtattcagagaacaaagaaagattgagaccaccaccacaaagattttgctgcagaatgagaatttgcagacatctctatttgctttgagatgcctttgcttttacctgggtgtagcttaaaatttttagtaaggaagaaaaaaatgaagaaattgtagctactaacacccacattctcaaagaacaagactggtcacgggcctcattttgtttgtaatctcagtactaattgtacttttcttttctatctttagtttccctttgccctgattttgttcacccacttttaggtagtgttttgtctcattatactctgtacagtttcataagccacaaaaatccactttaaaagcctcccagcaaatggaaatttagaacctgaagcagatcgtcagcacatccagacctataacaatttgctccttgtaagacttctctctcactttaaattacaggcaagaattcgtggtaacctttactttcagaaaattgtagagataagaaatctcagatatctggtccagccccatcatgttatgaatgagaaaactaaggcccaaaaaggtgtatgaaacaggcccaagattccacagtgaagtagtggtagagctggaagcaggtacttttcctgtaaatccactgtctccctttcctgggagtcctgatgctgtgtaaggtccctttcacaatttgtagacctaagtaaccaatttccctaagggctggtgaagatggcaaaaaatacacactagaggcaactgaataaccttgcaattttactcccagactaccgagagaataaaatatttattaaataattattcccataggttgatgctagtaaagaatttaactgagaaagagctatcagaaaaattagataattaactttgaattcaggaaaatataggttatcattaataatacaccatgattagcttttaaagcataagattcaagaagaggcaagtgagcatgatataatacagtacaaagaatgttgtgggaaggctgggataaaggtagttggtttaattttgaatatttaagctggttgaaataaagtttcttgattctttttctataattctaacaatttatttcaattaacctgttttacattcattagccattatttcctcatttattatttttttatgattaaaggcacaaaatatagctcagtgaatattccttctggaaacattttatcaaacccagaaacacaaattaatacttagcttcaggaaatgaaatataaattgttaattgcctttcctgctatgatcttgcaaaataactcacctggagaacgtttactgaaagggtaactgatttaaaaggtccaatcatcttagcgtggggttttaagcttctagggatgataaagagcctttaaaggaaaggcacctgtgcaaaaaaaccatttctatttgagagacagcagtagttttaatttccaaaacacatttggcctctctggttccccaatagccatcataagcctaaagtcagtgctttgtggagttgccatatggtagcactggttacttttcaggctctgattgccaaaaccccccgacactgtaaaattaagagatataccagccaattgcaacatatgaatcttgtttggatccttatttgaacaaattgtaagaaaaaaatttgagataatcagggaagtttgaacactggatatgagagtactaaggaagtattagttttctaggtgtgctaacaatattgtgcgggcatattaaaaagtgtccttatcttttagagacacacactgaaatatttacccagcgaatttgctttgaaatactcaaaagggtaatggaagagagtacagatgaaggcaagacagactatgagttgataattattgaagcagggggatttcattatactattctagttttatattctgtaaaattttccatcaaaaaagttatccacacagaaaacaaatgaataaaatttgaggcaaaaccatcacaacctactttagatcttgctgactatttttcttcttccgagggggtttcttcttcttcggtttatttgcgttggtattattttgcttattgtttaccccaaaatggcctgcagatatgtcactctgcaataagttgaccaacaatgggctcgttagcgtgacatccttattgactgggaagcctggattttgaccacaggacatctgatttccattgggagctccactgaaaggtgcattgaaagacatcccatggcctgagaagtggtttcccgaggcactgtttccctgcatggcctgcacatgaggggggaccatgttggtttgttgaatgctaacatcaggcatcatctgagataaactgacatcgttatttgctgtagtagcaggatcaccatgctgctgggccatgtgtgggctgggccctggtggccgcaggacctgtccctgaatgcccataacctgagatggactgttgttcacaggcccttgctggggcagcatctgtcctgacatctgtcccgtaaactgcaccatatttccttgcatgtttggagttggtcccctcattatctgggctggtcccggcatgacattggactggttctgagtgttaaactgctgcttattcccctgcatttgattggtcataatctgctctatcattgggttctgttggagcaaaacctgcccctgaggccccatcatctggttatgtggcgccatcatttgtgggccctgctgggaaagcatctgcttgggtggggtcatcctttggggcgagggcccaagattttggctcggggggttcaccatcatctggccctgtggcataagctgggcccttgaaaggatcatagggttctgagggttcaaggttccttgttgctggaccatctggccctgggagggcacgatttgctggtgcatgcccatcagctgagatggtgggccctgctggggctggccttgcatgttgctgaggttcacttgaggaaccccagaagtaccagcctgctgattgttcatgttgccatgaattcccatgaggctgggctgcatcatatttggcggcccgtgggacacctgcatctggttttgaggaggaccagctccttgaccaccttaaaaaaaaaaaaagtcacagtttcagaaataaatatttttatcttattggtattaagatactcaagttacattactcagaaagacatccatcacccttatatccactgaccaacataaatatgctgttgacatacttcctgtgagttttctaaactacaaagatgtggctgtgggataactgcttacattcccaatgaccatataatagagaaggagaaacagtttctacattcccatatggtatcttaaagatttaacgtttcaaagatcaagaaagtttactttctttcagattaaataatgagaaaggcagcatctcactgttttaaaatgacttgtagtggccaggctcgggtggttcatgcctgtaatcccagcactttgggaggctgaggcaggcggattgcttgagcctgggaggtggaggttgaagtgagccaagatcatgccattgcactccagcctggtgacagagtgaaaccccgtctcaaaaaattaaattaaattaaattcaaaaagcactatgggctactgaaataactctgctataagaatgtgaagtgtcggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaaaaaaaaaaaaaaaagaatgtgaagtgtcctcttaggaaaacctcaacaatcatgagaagacatttaaaaatgcttcttggaaaactgtaataataatgactctcaaaagctatgtgtgtgatatgtggatgctgcacttcaaagaaaataacaccaaggacaggtgtcctctgccctgatgtggtaaaaagcagttaatcttgatctggaagctgagcctctggtgggagccaactgactagatgacccatctggaagctgcaaatagaggaataataaaacctcagtgaccctctcctgcgcagtccctggtgaatcatgtggcacatgttttagtcttctcagctatttctaacttagacaaaagttgctacccgccttgctgtagtgcttatttatttactgggtctttgggattttcctatagctacttgcattatctccccgtttaactgaataactttgtagttaattttgtcccttttatttttcactttttttgttgttttgtttttgagacagaatctggctctggtgcaacctcggctcattgcaacctccacctcctgggttcaagtgattttcatgcctcagcctccccagtagctgaaactagaagcgcacaacaacacacccggctaatttttgtattttcagtagagacagggtttcagcatgttggtcaggctggtctcgaactgctgacctcaggtgatccacccgccttggcctcccaaagtgctgggattacaggctgagccaccgcacttggccttatttttcacttttaaatggggactagaaaatcccctacaatgaagttatgaagccagtccatgctccaactatgaaggcagggggcaaactaccttgttcacactatccagacttctcctgaactctaaggaagattttctaaaccagccttataaactcaaagtggaactccatgaccattgtatatgcttgtatacaataaatatactgtgtatattcattcaactgacaattattcattaagtacctgatacatagaaggcactttggtgctgaggtaacatcaataaacaagacagaccaaatccctgcatccttggagcctacagtctaactggcaagagacacaactaacaaacagacaagtattttttcaggaagcagtaaaagctaacaagagaaagtagggtgagagaagagaaagtaagagataagagtagagctactttagataggataaatggggaaaccaaaacatgtacacgtgggccgggcacagtggctcaggcctgtaatcccaccactttagaaggccaaggtgggtggatcacctgaggtcaggagttcgagaccagcctggccaacatggtgacaccccatctctactaaaaattaaaaaaatagcagggcatgtaatcccagctacttgggaagctgaaacagaaaaacgcttgaacctgggaggcagaggccgcagtgagccgagactgcgccactgcactccagcttgggcacaagagcaaaaactccatctcaaaaaaaaaaaaaaacacacacaaagaaaacaaacaaaaaacatgtacatgtggaaggtaccatataaaaacacaaaatagctgtgatagggtacaagaatgagaaatgactttgtcattgttttaaaacatacttttttttttttgagatgaagtctctctctgtcgcccaggctggagtgcagtggcgtgatctcagctcactgcaacaacctctgcctcccaggttcaagtgatcctcccgcctcagcctcttaagtagctgggattacaagcgtccgccaccacacccggctagttttttgtatttttagtagagacagggttttaccacgttggtcaggatggtctcaaactcatgatctcaagtgatccacctgcctcggcctctcaaagtgctgggattacaggcgtgagccaccgcacctggcctgttttaaaacttcctataaaaaaacatgaatttgctgggtacagtggctcatgcctgtaatcccagcactttgggaggccaaggcaggtggatcatgaggtcaggagttcaaagaccagcctggccaacatggtcaaatcccgtctctactaaaaatacaaaaattagccaggcatggtggcgggcacctgtaatcccagctactcaggaggctgaggcagagaattgcttgaacctgggaggtggaggctgcagtgagccgatattgagccactgcactccagcttgagcgacggagcaagactccgtctcaaaaaacaaaacaaaataaaaaaaaaacaaacatgaattcatataactcaggaatgcagttttgcattagcagatagagaaattcaagcagtttgcactacccttctgttaccctgccagaaatagtgtgaactttttttgtaaaagtcagatttttgtctcattccttagtgatttacaattaaagttggagtcacattactaaattaactccaggagggatgggaattcagaaactagttgcactatctcagtccaaactgcttcaatgagaaagggtaagaggattagtcatgtggtccttaagcaaccagaaacatgaagtttgagcttatacattactgctttgcaaatactttttagccattcccctgtatcttatttcctctccaaaatttcttctttttgcagtacactgttggtagtaaacgtgaactgatgaagtttgaaaaatatcacactgtaaaccagaattcagacactcagcataaacaaagcttaacatgtaccacgtagagatttaaaaagttgcagttgtccaaacatgcctccatgcctttgtgtctgtggttttcatttgccagaaatgcctttttgccttttactacctgagcaagctctaactcaggggtcagcaaactatggccctctgctggtctgtaaataaacaagtgtttggaatgctaccatgcttgtttgtttatgtattgtctatggctactttctgtgctatcataacaaagttgagtagctccaacaagagactatataacctgaaaagccaagaatatttactatctgccccttcagagaaaaaaaatactgctgattcctgctctaactcaagttccatctcctcttagatgtttctgagttcctgtgacattttacctacttttgatatattgacaaaagttactgccctgaaagaataattatttatgggcttgaaattaaggggagagaccaagacttattacttatctgtatactcctgttgtctatcaagtctacgacacaatgctcaataaatgctggctaaacaaatcacagaaaacaaacctgcatgctggacattttgatttgcttgcagctgaggggctcctgaattcccaggggtggttgctgtggtcgaaggcacctgaccttgcataaagttcggattggcctgtcctgctgagaagccaggtgggaggcgtttaggcattccttaatagaaaacaatgagtaaggcagttacctagcaaatttatactcttgcttagatatggaatgaataaggaaggatgagctgcatgaagtctccactggcttagctctctctgtcacactggtaggatctttaataataaggttgggaaagatggttaaaaaaatcaacacaatctcttatatgaggcattgtcaaaatgaaaaataaatactaaaaaacttacacttagaacatgccaaggaaaagatggcaatctgctccctaaatgtgatctgaggccacgccacagcaaggtttgagggctcacttttctctgtaattaacaatggaccccaaaactttagttattttaacacaggcaccaaaggaatatgctaaattctctcatttcaaacaaattgatgtgaaatagtataaaacaaagagatgggtcctgatattaaggatagattgattatttttcctttgagggaaactgatggcaatctcctttgcagaaaatttccccccattattgcgcttgtctctttggaagagacaggagattagaaacagttcatgggagcttcaaagtgatgctgtattaaatcattatgctttcccctcataaggtttgctgtgattctgacaggtttggtaccaaaaaccatactctaatggaatctttctcaagtatcagttcctttttggaagggctaattttagaaaacttgtaataaggagaatctcagaacccacttatcatttacaacacaggccttgatgtggccagatcacctaggtgagcatatcatctgctctatgaaagcatcaagacctaaactcacttaaaaatttattacattcattcatttatttatttacttttatttttattttttgagatggagtctcgctctgttgcccaggctggagtgtggtggagcaatctcagcgcactgcaacctcctcctcccaggttcaagcaatcctccctgcctcagcctcccaagtagctgggattacaggtgtgcaccaccacacccagctaatttttgtatttttagtagagacggggtttcaccatgttggccaggctggtctcgaactcctgacctcaggttatctgcccgccttggcctcccaaagtgctgggattacaggcgtgagccactgcgcctggccatttatttttttaagggccaaattttcaatgtcctgaaaaactcttagtagacaaatatgcatttgtcctttctttaacagtgacaagtcccatttgcatgctcccactgtaattaaatcagtaatcacatttgcaggagggactacccagcttccactgatctggggtagatacccagaacagtgaaatttggagctgaaacatccttgcattttctaagaacttcttacaattcaaatattagagcctgcatgtcagcaaaattaattacaagagagtaaaaggctgatgagcaacttaacttcatcagaaaccatgggaacatgcctttgctatgttgcactaaagatgcaaggggttttttctgggtaggcaatgggtgtcttttggtggggagtatgtttatcagatgacagtattactgatactctataccttactgaaaagctccaagcacattcatgtgcactagatcaatgattaataagaataaataataaacatggagatggataagttttactgtaatcgttttacctctcacacattaagctccattgctttttcttcatacaagaggcaccttacaaaataaataaataaatctcctttaggtataactggtggaattccctctctaaggagcaggcattggcattataaaactataaaagtcaatgatttctgaacttattcccctttaatactttaaccaaacttaacaagtaccatgcttactattttattaactaggattatcaaaattgataactaaaagggccttttcttcaatgagaccctgttctttttattttgctctattgcataatcttaatttttcagcaactgagaagtttaaattgttaacaaaatgcatttttcttctggacattttaatttactagtacaagatcaagcaaaaataatttgaaaaacaaaatgaacatctctacattgaattttacctgaattttagtccagagagctagcttaaatttaaccagtaagatgctgcataacgtatcaagttaactttaagttatatcaagtgtcaccaccatatccacaaaaccaaataattatatccttactccactccctccattaactctaaaaactgaagttctactaagatctagctccagcaaatttaccaacacaaatagctacagtgttcctcacctcctaggcctggatgtaaactctgtggcccctggtttggtggttgctgctgcatcaccatgaagttaggtggcacatttccctgttgaaccataggattccgacccggagagctgacaggctgctgaaatccctggggaagtgggttattttgaggtggccttggtcccatctgctgctgagtttggttaaccgttggggaggatgcaggggatccctgctggaaggaggagggtgaggaggcaggagacttgttggtgaggtggggctgctgcaagggagttgggaccctagagggccctccctgcaaactcttcatctgaggagctgtgaactggcctgggttgctcatctgaggaaagtttgtgtgggcttgtgaggcttgctggctgccaaagggatatggagggggagggtgggaaggcgtctgtaccgtggctaaggatggtcttgcctggagttgctgttgcattgggccgggcaagggagccttcttccacccttggtttgcagtcattgtgcccagagaaccctgggctggaggaggttgaagggctccagaaggcagctggttccagcctggaggaacaggcacctgagttggggcagtaaactggggtcgaattccctgtggctgttgctgctgatgttgctgtgggggtcttgcctgcaactgttgttgctgctgttgctgttgttgctgctgctgctgctgctgctgctgttgttgttgttgctgctgctgctgcagctggggaaaattagctgggttcatttgtctgttcacagagacaggctgcattgggtgatgtgggggagctaaagatcctgagggatgactttgctgctgtatatggagcccagagaggagtggatccattgcatctgtttaaagatagtcaacaaagcaataattaacctactgcaatctagatcttagagaagtggcctttgtaattctggatatacagagcaaaatctgctggtactattcgataaaataaatgcttgtgaataccttctatgtatgaagcaacataccaagatgatgaattctgtcttaaaaagagcttggtcagtagtggacattaagagcgaagtgtaaaacatggagaccagtatttaccaaatcatattctggagaactatgttaattagcattataagaaaacaaaacaattaggtttgggaaacactgaacctaacaaacttagatgcgtttcttcactgtaggactttcagtgcctccaatatgttacttttgaatctccaggagggagggtaaagaatgatgcatttaccaaatttacttgactacagaattctatgtaatgagcatcttgcaggactacgcaggccaaggcacacttttagaaatgttggggtataattgataagaaaacaatgagaaattctgaaaagaaaataatgacatttagtttgaagaaatcaggtcagattttgtaaagaaggttgacattgtgagtttggaaattagaaattcagcatcagagataactgaattttataatgatctgtgcagaaagtttcagactcttcatcctcaaagattggaagtcattacctgactgagaagcagggcgaggagtcctgggctgcagctctggattggggcctggtgccatcatggaagatgacacatttccacccgggggtatcataacagtggcagggttgttcatccttattattcctagaaaaaagatccctaaaatagagtactggaattggcacaatttttgttttttaatgagttatttcaagaatatgaaaagatatggaaaatttgtttttttttttttgacagggtctcgctctgttgcccagtctgccaagtggcacaatcacagctcactgccatctcgacttcccgggcccaagtgatccttctgagtcagcctcccaaatagctgggaccatgggcacatgccactgggaccacaggcacacaccactgtgcccagctaatcgttctatattttatagagatggggtcgctatgttgcctaggctggtctcaaattcctgggctcaagcgatcctccagcccagccctcccaaagtgctgggactacaggcgtgagctactgcacccggcctggaagtttctacacccaccatctacctttttaaaatttaaaaaatttgctcttatgtccttcagatatatatgtagatacagcagaagccccctactccttccattccacttcctccctcttattgcaattgtggttaacagttctgttcttgtttattgaccttttctgtatctgtaggtaaactgcactttttctgtagataaacattttttgtatgcttttaatctttgtataaatggcaccttactatatgcattctttgtcagcttcctttttcacttaatgtattttttgagattcatctctcttgactgttataagggttccattgtatagaagcatatatccacccttctgctgatgaatactaaggttttatttttcctttattcttataattttgcaatgttgtgtatttgtcatgaattcttgtggatacatgagagtgtctttagactatatatttagaattgctaggttttaaagtctaagcatctttaattttactagatattggtaaactgctctcaaaagtggttataccaatttatactcaaactagcagtttgagaactcctctttctccatatctgaaaatttctgatactgctaaacttttcagaatttatcatctatgctcctaagtgagaataggtcaggcatggtagctcatgcctgtaatcccagagcttttggaggccaaggtgggaggactgcttgaggccaggagtttgagaccagcctgggcaacatagaaagaccccatctctacaaaaaataaaaaaatcagccagtgtggtggcaagcgcctggattcctagctatttaggaagctaaggcaggaggatcacttgagcccaagagtttgaggctgcagtgagctatgatcatgccactgctctccagcctaggcaacagggcaagagcctgtcttcaagaaaaaaaagtgacaacgcctatacttattctcttttcctttccttggctacagaattctctgtcatggagcatcttgcaggactaagttggccaaagcacacttttaggaatgttgaggtatgaataagagaacaatgaaaaattctaaaaagaaaatgatgacatttagcttgaagggcagattttgtgacattttgatttttggcatcgaggtgaaaataacctcaaaatgagttggaaagcatctttcttctttttctatgctctggaagaatgtgtgtatctgttctttaaatgtctgagaaaactttcctgtaaaaccatctgggcctataggtcatactaattgatttacagggaaacagatttttatttcaatttcttaaatggctatagacttttcaagttttcaatgtcttactgtcaatttttattaaattataattttgccaacactaaaatttattagcatagttaattgtggaatatattttttctattctttttaaaaaatgatatataattcatatactataatattcaccttttaaaatttgtacttttttcattctttacattgtttgtgccctctttttttccttggtggtcttagcacattcatcagttttagctgtcctttcaaagaaacatcttttgggccaggcacggtggctgacacctgtaatcccagcactttgggaggctgaggcaggtagatcacttgagatcaggggttcgagatcagcctggccaacatggtaaaacccctgtctctagtaaaaatacaaaaattagctgggcgtggtggtgggcgcctgtaatcccagctactcaggaggctgaggcaggagaatcttttggttttgctgttctgttgtttttttgattcatattttacttatctctattcttatctgtattatttccctcataacttacagctctgctcaattcttaagtcagacacttagcttgttaattttcagttggtgttctttcttaatataaatttctgaaggcttaacatttctttgaagtgttgtattggctacatctcacacatttcagtatatattattctcataattccattctaaatattgtctaatttccatcaggattgcttttttaaatcactaagtatttataatgcatttttacgtttccaaaaatatgagatattttggttatgcttttttttttttgccactgacttaacctaacagcactatggtcagagaacagaatctatgtgatattaatatttggtatttactgaaacgtgctcttggaataatccttggtcagtttgtataaattttccatttatgcttggaaatattaagaattcttgaattatgactgcatggttttgttttgttttttttctccgagatggagtctcactctgttgccgaggctggagtgcagtggcgcaatcttgactcaccacaacctctgcctcctgggttcaagtgattctcctgcctcagcctcccgagtagataggactacaggcacacgccaccatgcctggctaatttttgtatttttagtagagacggggtttcactatgttggccaggctggtcttgaactcctgaccttgtgatctgcctgtctcggcctcccaaagtgctgggattacaggcgtgagctatcgtgcccggctgactgcatggtttctatatatgtccattatataaaaagtattttgttattcaagctctcctttatccttactaattttttacaaacttggccatcaattactcacagaggtgtattaaatctcccctaaggtttgctgtttacatgcaattcttaaatgtcttgaggctaggttgttaaatacgtaagagtttagcaacttcctggtgaatttttccttttacattatatagtggccctatataccttcagtgatgctgtttattttaatgtctgctttatctggtaaaaatattattatgcttttcttggttaataatcaccttgttaatctttctatctttctaactttgaaccttctgagtccttatattttatgtgtttcctgtaacagcacataggtaaacctgagaatactattctgattaatcatttcctttttatcagtgttcataatccatttacctttattgtttactagtatattttgatttttttgtcattttatgatttctatttaccctttttttctattctgttttcctattttcctgaattttactggattaattttttttcatcatggtcatcctctttaatcctccactactagtttagaagttatatattccattcatattattttactggtatctttaaaatgtcagcagacatacctgacttaaagtttaaagacatatatgatcatcattattactaaataagtcaatgcttatttagatttaccccatgcttatcaattatttagctcaccattccttcttagatcttatttcttccatcttaggttcaattttcttcttcctgaagtacatccttgagcagttcaattagcaagggtctgttaatggtaaattctcttagtctctttgaaaagctctttatttcatactactcttgatagtatagctatgtttaaaattctaggctgtcaattatatcctcagcactttgaaaaaattattccaatgcttcctggcctccaatgctgctgttgagaaatcaagaaaagctgatagtctttcctttgtaaataatacgtcttttcttttgggttgcttttaacattctgtttttcaatgttctgtagctttacaatattgtgtctagatgtagttttatttttattttgtagtgctcaggaatactgggcttctgaatctgaggacttacgtctttcatccattctggaaaaaattttagccattctttctttgactgtcatccctcctcaatttctttatcttcttcaggaactcttttcaaacatatgttaaaccttctcattttattcttcttgtctcttgacctctttcatatttccatctctttttctctgcgcatcctgagtgatttattcaaattcaccttccaatccacctatttctaatttgctgaataagttatccactttgatgatttttaaatttctgtaagttctgttccccccatctctccttatgtttgatagtgtcttgttttcttatgattctcataattgttaatactctgacattcctattacctaaaattttagagggagggaatctaatcctaaattgtataaattcagaatataagctcatttatatcaggctttaactaggagaagtatgcaatgacttgggttgagaaaatacgcccctccacagcttcaacagttatcaccagtctagacctacctaatgttaatgacttagcctggctattaatgggtattcactaacatatcaaatgtccaaaatgcaagagggtagagaagacaattccacaacacccattctcccacctaacgtctagagccccagcgaacacagacaaatttcccattaatttccctatgccagagagtgacattttcctaatctatctttcactgaaaattctggcttcatgaagaattctgaattctaacttgcttcttcctgttgacccaaggctttatcttctatcccttcccggccattaaaacccaaatgctttggaccctgcagaatctcatttgtttactgccgtttaaatattcacctttgacatttttttttttttttttttgccctagggagttcctctactttctttccccatccctctgcttccaagcccagctacattttttttttttgttttttgagagggagtcttgctatgtcacccaggctggagtgcagtggcgcgatctcggctcactgcaagctccgcctcccaggttcatgccattctcctgcctcagcctcctgagcagctgggactacaggcgtccgccaccacacccggctaattttttgtatttttagtagagacagggtttcaccatgttagccaggatggtctccatctcctgaccttgtgatctgctcaccttggcctcccaaagtgctgggattacgggtgtcagccacagcgcccggctgcccagctacgtattaaatgttataggccggacgcggtggctcacgcctgtaattccagcactttgggaggctgagacgcgtggatcacttgaggtcaggagttcgagaccagcctggccaagatggtgaaactactaaaaatacaaaaattagccagacatggtggtgggcacctgtaatcccagctactagggagggtgaggcagagaactgcttgaacttgggaggcagagctcgcagtgagccaagatcgcgcaactgcactccagcttgggtgacagagcgagactctgtctcaaaaaaaaaaaaaagttatattttaagttttgtagttggagaggacagttaggctaatgtttatctgttgaaactggatctgtttctgaggaatcgcacctggttttttaaagatggtagttagacagttaagaaagctctcatgagggcttggtgcggtggctcacacctgtaatctcagcactttgtgaggcccaggtgggtggatcacctcagagcaggagttcaagaccagcctggccaacatggtgaaaccccatctctactaaaaatacaaaaattagccaattagctgggcatagtggcacctgcctgtaatcctagtcactcgtgaggctgaggtgagacatcgcttgaatccaggaggtacaggttgcagtgagctgagatcatgccacagtactccagcctgggtgatggagtgagactgcttcacaagaaaaaaaaaaaaagagaaagctctcatgagataagaaacaggtttttggctgggcgcgatggctcacacctgtaatcccagcactttgggaggccgagacaggtggatcacaaggtcaggagatcgagaccatcctggctaacacagtgaaccctcgtctctactaaaaatacaaaaaaaaaaattagccaggcatggtggcatgggaggctgaggcaggagaatggcgtgaacctgggaggcagagcttgcagtgagccgagccgagatcgtgccactgcattccagcctaggcgacagagcgagagtccgtctcaaaaaaaaaaaaaaaaaagaaacaggtcttcttggtccataatgagcttcctaatcccagaaaatttcaagtatatgctgactacatgttcaatagtgacactataacatgcattccagtactagatgggaatctgcacaagatccaaggttctcacctaggggaaattttgtcccctgggggacatttggtaatgtctggagacattttaagtggcacaaatgcagggaagtagtggtgctactggcatctggtgggtagaagccagggatgctactaaacatcccacaacacacaggacagcctcccacagcaaaaaattattggccccaaacatcaatagtgttgaagttgagaaacttgaattaaatgactactatagtatccccacaaatcttggaattctataaggctatgaaaaaaaacaggctatggatttagttttagttgcaaaagactcttgcttattagctaactttctgttgcccatgctaagagaagaaagcagtactaagaataattgaaaaaccaactgttgtagatacacagttctaaagttacttattattgttttagaggggatttaaggtctctttccctagaaaaatttagctgttcagtttaacctaatattaaactttgtttgcatccttcaagtctcaatagacaacagagaaaagcaatcctaaaatatgcttggcagtaaagagagatatcttgggggttaagatgttactgttactacaggtcattactaattgattattcctgaaactttatactatatacattatcacaatctgagtccttcattaaataccaatctaatctgatttcaacctaaagcttctcagtttcctaggttgataatcaactatagcactataattggctgggtacggtggctcagttcatgcctgtaatcccagcactttgggaggctgaggtgggcagatcacttgagcccaggagttcaaccagcctggtcaacatggcaaaaccctgtctctacaaaaaacaatacaaaacaaaacaaaaataagccgggtgtggtagtgcacgcctgtagtcccagctactgcagggctgagacaggaggaacacttgaccctgtctcaaaaaaaaagcactataatttacatgcacttcttagagatacttagtaaacatgcttgctatttgccagatactagcccaagagagcttttaattagggtactaataacagttaagtggcgtcttaacattttaagcctagaagggatctctagcattgtttccagaacataaagatgtttataggcaactagagtcagtacatattaagtcctttggccaggagttgagattagaacccagatttcctgatgctcatcccaggtttattcattctttcattaactatatctaacttggctaggcttttcccactctgcttctggcccatgtccttccagtagtggcaacagtgtcatctatcatttctcataaagctaccttaacaccaaatgctcagacttctgtggggaactacatctatgtacacaataccaggctggatattttacatctattttatggtattccacaacagcccaacagcacaggtcctgacatatatattttcctaagtcctaacaagaacttaggaaatgtttgctacactgctcagggctcttctaccttcaagcatgagctcaaaagatggtaggtattattatttcattttatatgtgaagaaagtattgcttggggaagtacagtaactagcttgaggtaacctgtaaatggtagtaccagaatgaaaacctagttccaattctatgatcagttcattagctacagttcagaatagcattttttttgttttgttttgagatagagtctcactctgttgcccaggctggagtgcagggtgcgatctcggctcactgcaacctccacctcccaggttcaactggttctcctgcctcagcttctcaagtagctgggattacaggcgcctgccaccacacctagctaatttttgtatttttagtagagatggggtttcaccatcttggccaggctggtctcgaacccctgacctcaggtgatccacctgcctcggcctcccaaagtgctgagactacaggcatgaccaatcgtgcccggccaagactagcatcttataaattgagctcctctatactgctgcatttctccaacagctactctggtagagtgggaggggaatgactgggtaagcaggttcttactctgcttcaaccacagcagctgtgcttttctgttttatttgaataaagggtcctgaagctgaaaaaattggaaagccactagtgcagtgaaaaaagcactgaactgggagttagaagatctgtgatactagtttatcgctccttgaccctgggcaaatcacttcctttatgtgagttccacagcttcctctgctttaaatgacagccaactcaattctaatattctgagattcaatctcagaatattgagttcaatctctgaagaagaaatttcaggattactagaaaaggaagcaatttataactctcaaattctaaatacataaaaacacatattctctcagatacatcttcagattccacataagcacacaagaactcaattcacagatattctctgcctcagagaaagtgggagttggaaagctacattctccattgtactattaaaataatgagggtagaaaatgtctcacttatttctatttccaacagcacaggtcatgtcacacaacaggaagtcaataaatgtttgctgcatggctcagtgttcatcaacctttaagcacgagaccaaaagattgcaaagatgcttcatgctgtgacctctagcctccgggaaggactcatgtctagctttcctgattcagcaaatagagatgttaagtatgccatgaacccccacctatcttgcagggctcaaatgatcaaataagccaaaaaaggaaactagtaaaatgtcatacaattgagtgggaggtcttacctggaccacttgccataggaaatcccgcctccatcctaactgaatttccagctcccatgggtccattcattctcacatcttggcttcggttctgagccaaagccaggttaatagcaccttcccctgaaaatgagtcaagtgataaaaaggaaatcattagaataaaatgcaaattttgtttatagacagctatataagtgctttagttttctgtgcttttgaagaattatggttagtttaccaccagaaaaatggtgggttcaatgtagatgggtctttcttcaacccatctaagcaggtttcatgaagcacaaggagatataaccaattcttacttgtaatagggaagcagggtgaccatgaatgatgcttagtatcaacagagatcctggaactctgaatatttattttcaaccatcttaccaattgtgtgtgtgtgtggggtgtgtgtgtgtgtaatggaagaaaatgttctcaaaaactctcaaaatcctagacttccttttggtaatttatgatcagaaggtagacactaaatataagtaggtttaaagaagaaagaacctatactggtgtggggacactaacacttgtgaacaaaataccaattccattcaataactgcaatataaacatatttccagcaggaaaaaaatcatgcaatgaagaggagataggttgctacaaatctactttctgagacacctaatgacaggaccaatacttttataggtttttgttttctgagatggggtctcactttgtcacccaggctgcagtgcagtggcacagtcatatagctcaccactaccttaaattcctgggcccaaggggtcctgctgcctcagcctcctgagttgctgggaccacaggcgcacatcactatgtccggctacgtataggattttttttttttttgagatggagtcttgctctgtcactcaggctagagtgcagtggtgtgatcttggctcactgcaaccttcatctcctgggttcaagggattctcctacctcagccttccgagtagctgggattacaggcgcccaccaccacgcccagctaatttttgcatttttagtagagacggggtttcaccacgttggccaggctggtctcgaactcctgacctcacgtgatccacccacctcggcctcccaaagtgctaggattacaggcgtgagccacggtgcccagcctgcataggatttttaattttaccttatttgagcttcacagtaccctcataggtaatgttactagaagtgttccaattaagtagactctaaacttagaggcaacttaaatcttacttggtccaatgataaaaacgtctctgaaacaagcaacagaatgtttcttgcacttaatccaaaattttgactattgttattgtaagagagcaccaccttgtggagagttaaaatatagctagtctgtggctgctgagctgaaaggctgcactcacccaagtccttctaaactgtagggttctgattcacagggtctgatggtaaaacagaaagttaatgaggtatggcagtttcctctgttctgtcactgatctaggtcagccttccttttttttttttttgagatggagtctcgctctgtcgccaggctgaagcgcagtggtgcaatctcggctcactgccatctccacctcccaggttcaagcgattctcctgcctcagcctcccgagtagctgggattacaggcacgtgccaatacaagcagctaatttttgtatttttagtagagacggggtttcaccatgtttaccaggatggtctcgatcttttgaccttgtgatccgcccaaagtgctgggattacaggcgtgagccaccatgcctggctaggtcagctttctatgtctattttaaccagggaggttcactggtcacagggaacaaacagcctaccaaaaaggaagcaatcactgggagctaccagatgctatagcttgcctctagaagtcaggcgtaaaaagagaaacagaatacaggtcatgagggtttccattaaaggaagggaactattaatatacaaaatttgttaagacattctaagtagaaagaatattgttctggaaaaggacatcagttcgtatcattccttaaaaacagttccattgcttcccactagtttagaaataaaggccaaacttctttttttttttttgaatcggagtgtctcactgttgcctgggctgcagtgcaatggcgcgatctcggatcactgtaacgtctgcctccgggttcaagcgattctcctacctcagcctcccgagtagctgggattacaggtgcttgccaccacgcccggctaatttttgtatttttagtagaaacggggtttcaccatgttggccagactggtctcgaattcctgacctcagacaatccgcctgtcttggcctcccaaagtgctgggattacaggcatgagccaccgtgccaggccaggccaaacttcttagcctatacaaggccttaaattatctacctagccaagtgttgttcaacagaaatataatatgagccacatatgcaatttaaaattttctagaagccacagtaagaaacagatgaaattatcatttattttacttaatacattcaatgtattatttcaacatgtaattaatgtaaaaattattattattttttgaaacagggtctcactctgttgctcaggctggagtgcagtggtgagatcacagttcactgcagcattgacctaactgggcttaagtgatccttcccacatcagcttcccaagtaggtgggactacaggagtatgccaacatgcctggctaatttttttattttaaattttaaattttttgtagagacagggtatcactatattgctcaggctggtctcaaactcctgtgctcaagcaatcctcctggcctcagccttccaaagtgctgggattacaggtgtgagccactcagcccagccaatgtaagaattattgagatattttacattcctttggggaataccaaatcttcaaaatgtaatatgtattttatacttacagcgcacgtcagttttaactagccacattttcagtgcctaaaagcaacatacagtctgtggctaccaatattggactgcccatatttagccctgtctacctctttaaactcatctcatgctatttttctccttcaatagcaaggattcagccccagtgtttccttttagtttcttaggcacacaaggctgcttctcaccccaaggcctttgctcatgcggtttcctctgcctagaacagttctctgcactcttcgcatagctagcttctcaattttcatgtaatcttaagtgtcacatgcccaaaaaggcctctaccaaccatcttatccaaggttaggtaacttttatcagaacatcttgttatttctgcagagcacattccatgtaatcattcactcactcgttttcttgcttgcctcccccatcactatacagggttaattacaagtctgtccttgttccttcacatctgttgttccagcataattaatagcattctctttcactttcagaaatgtcctaatttaggctaggcatggtgactcacatttgttaatcccagcactttgggaggccaaggtgggaggattgcttcagaccaggagttcaagactagcgacatggtgagaccccgtctctataaaaaattagtcaggtccgtggtggcacgcacctgtggtcctagctactcaggaggctgagatgggaggattgcttaagcccaggaggccggggctacagtgagttgtgtttgtaccactgccctccaacctaggcaacacagtgagactttgtctcaaaaaaaaaaaaaaagtgtcctaatttagatgataaattatatgactatctataatacatcatttatacataaaatagtgcctggtacgtggcagatgctcattagctatttattaaatataatggtcatcttataaccttataaagaattataagcatttttctatatgacaaattacttcctggaaaacctcacatttatcaaatctcatactgacaataacagggttagggcaaactgaaaacctgtgagactttgtaaccagagctctaataaaaacaataactggtggaggcaaaatgccagaaaaaaatgcagcagaaatgcctggttaaaggtgctgagataatgcacatgtagtggagttctgagccagcggggctgccattatggtgggcacaggaagaaatgcaacctgtcatgaactgagagccacacaaggctgggggatgcacgtcaggaaggcatacgaatatacactctcattcttaattttaatagagctgaaaagactcccacacatgcaacagctgagtgaaaagctttttcttgttgataattataattctatttctactattccagctcctcttacctaagaaaaaaaatcacatattaataaacagaatttccacactatactgctatcattcccctatttaccaactgcatatatgctaatttgtgtcaaagagaacactaccggctcccaaacttgccaattaggggtccacaaactacgtcctgtgggccaaatgcagcccactgcatgtttatttaaataaagtgttactgaaatcctgccatgtttacttgtttacatatcgcctatggctgtttttgccctacaagatggaactgagtacttgttgagttgagatcttatggcctgcaaagccaaaaatatttattcttggccctttacagaaaaagttagcagactactctttagatcaccatgaatttacagagggggcacaaaatgtcctcaaaaaagatgtttccccaattccctggccaaaacttaaaaaaggaagggtacaggaagtatttgtcaatggagaacggactgttgggagaacctgtccctcaagccttgcagcagacacgatagtggcaacattgcttcattccttcttttttgttgttgttgttttgagacaaaattttgctcttgtcgcccaggctggagtgcagtggcgtgatctcggctcaccgcaacctccacccaggaaaattttgctcgacacccaggctggagtgcagtggcatgatctcggctcaccgcaacctccacctcctgggttcaagcaattctcctgccttagcctcccgagtagctgggactataggcacgccccaccatgctcggctaatttttatatttttagtagagacggggtttcaccatgttggccaggctggtctcaaactcctcccctcaagtgatccacccaccttggcctcccaaagtgttgggattacaggtgtgacccaccgtggctggccaacattcttcttacaacttacaaaatcaacagcccagttccacaaaagcaatagctgctgccatcactttcactcctgctgaattcccaggagcatgggaacagagatcatctgggacacacatgtagcctaaaagttaaagaactctttctgtattgtgataatcattgtcatatgtgaatttcataatttcttaaaatatgttatctatttgcttccttgctagtactcatgtttaaatttatggctataatgttaagggagaaccagcattatattgttttaggaagtaggtctgcttaagaaataaaactggtacttctttctccagtgaaaaacactatcaattaaggttttgaagcctttaaataggtaacagagaccaaaaaacatgtggggttttaaagaaaccacttatgtattccttaaagtataaacagcccacatattgttattttatccaatagttgttcgacttccacttttcctaatagttcatcctacagattgctgtgaattaattgtacttttctggatccttttagatagttccacatttttcaaattaaagtggtattgcttaagccactattctctcatttatcaaatggtgaaaattatcccatttctcaatctacatataaccctttctaaataatttgtttgttggtattgcccctttgagggcacagcaacctacaatgctagactgcataaaatgtgtctcactcctataaacaaaatgacctcgactgctcaggtttcatggagcaattaggttctacgtaagcacagggccaggaggacctggactaaagtggaagggaaagctggaattgctggttgtcacctggctgtatcaacacaggaggggaagagagggttctagttcactgagcttccaaagagctcccccacacatggtaggtacttacatctctcacaggtttgtcttccttactaaagtcataagctcttccgagtttataacaataaggacaatatttatcattgtattccaaatgctaaagcttatagtctatggggataaaacaataatcaaataattgctctatgaaagtgtgagataaatgatctgagggagagaaacaaacttttgtgagagcacatagcaaaggactctgacttgccaaaggagttcagaaaatacatcctcaagatttaagctgatacttgaaggctgagcaggcatgaactaggggaagggggttggtagggaatagtatttcatttagagaagacatcaatgcaaaggacctgtggcaggaggaagagaaagctgagaagctggaacacagggggcaagggaggaaagttacacaagataaggctggatgaggaaggtagaggtgagaccatgcaaagcctgaggtcatggtaaggagtttggtcttcattctttgaataataccaagagatagcaggattttaatctaggggtgtagggttataggggtgtaggtgtgtgtgtgtgtgtgtgtgtgtctgtgcgtgcgtgcacgtgctcatcaaattctcattttgaaaaagatcattctggtaaaaatactgaaaatgaacactgcgggccggcgtgatggcctgtaatcccagcactttgggaggccgagagggtggatcacctgaggtcagaagtttgagaccagcctggccaagacggtgaaaccccatctctactaaaaatacaaaaattagctgggcatggtagtacatgcctgtaataccagctactcaggaggctgaggcaggagaatcacttgaacctgggaggtggaggttgcagtgagctgagatcatgccactacactccatcctgggactctgtctcaaaaaaaaaaaaaaaaaaaagaaaaaaaaaagaaaagaaaatgaatgctgctacaaaaggaaaggactgttgaaggcttcataatctgttagacgaataaagaaaatactaaagtttatttggtggaaggaaggaagcaaattaaattatatgttaagctgggtacagtggtataggtgtagtcccagctactcaggaggctgagatgggaggatcatctgaggccaagagtttgagtccagcctgggcaacacagaaagacactgtctctaaaaataacaacaataacaaagaaaaccacacaactaaataaataaataagacaaatcaattcctggtcaggatgccaataaaatcaaagtctgaaagactgatggtcaaaattagccaaaggaatggagtccaaggctacagatgctaaagaccatcaggacccagcaataacctcagtcagtccctcttcatcctaaggtgctgcaaagcaaagtacaagttacatgagttgcttggcattctgaaacacaagagcagaggaacagacaaagcagcacagaaaatcatgctatattctactgttgtaatgattctggtctagatgggcacatggcaaagtaaaagaccttcaatctgaacggagagaatccctaaatcccgaagctgctggttgttgctctgagcaaggatccgtagccgctccgctgcttcccgggggatgttgaatgtcacacgcacgctgttccagggctccaccttctgtacttttagcttgctggactcttgattgtgaaagaaaaagaattatattaataatcttttagccaccagaggagatggaattaaaaaacaaaccaaaagagcaaaagaataaggtggagcaccagcttggaatagctaacagagcatatgctttggagctacagactcaaatctaatcctagctttgccacttagcacctgggtgaccatgaacgagctatttaacctttctgaaacttatctttttcttttctaaaactatgaaaaaactacttcatatgatttttgggtacaaattagataatatatgcaaaaaatctagcatagtacctggcacaccacaggcaatgaacggaaagccgtaagatggagaaaggaccataagaaagaagagagaggttaagtttaaattaatagaataggctcatgcctataatcccagcacttcgggaggccgaggcaggtggatcacgaggtcaggagttcaagaatagcccagccaacataatgaaaccccgtctctactaaaaatataaaaatttgctgggcatggtggcatgcacctgtagtcccagctactcgggaggctgaggcaggagaattgcttgaacccgggaggcagaggttgtggtgagccaagactgcgccactgcactccagcctgggcaacaaagtgagactccgtctcaaaaaaaaaaaaaaaaaaaaaaggtaaaggacagttctccagaaaagatacacaaatggccaataagcacatgaaaaaatgcttgacataactaatcattagagaaatgcaaatcataatgataagataccacctcaccaccattaccatggctactatcaaaaccacagaaaataaacaatggtgaagatacggagaaatagaacctgcggggcacggtggctcacacctataatcccaataatcccagcactttgggaggctgaggctggtggatcacttgaggacaggagttcgagatcagcctggccaacatggcaaaaccccgtctctactaaaaatacaaaaattagccaggcatggtggtgcacacctgtagtcccagctactcaggaggctgaggccagagaatcgcttgaacccaggaggcggaggttgctgtgagcccagaatgcactactgcactccagcctgggtgacagaacaagactccgtctcaaaaaaaaaaaagaaactggaacccttgcgcactgtcagtgggaatgtaaaaggatacaagctgctgcggaaaacgacagtttctcaaaaaaaattaaaaatagaattaccacatgatgcagcaattctacctcggagtacacactcaaatgaactgaaagcagagtctcaaagagatatttgtacaccatattcatagcagcattacccacaatagctaagatatggaagcaacccaatgtctactgacagatgaatgaatcagtaaaatatggtatatacatacaatggaatattattatattattatttgagacggaatcttgctctgtcaccaggctggagtgcaatggcatgatcttggctcactgcaacctccgcctcccaggttcgagcaattctcctgcctcagcatcctgagctgggactacaggtgcatgccaccacgcccagctaatttttgtatttttagtagacacagggtttcaccatgttggccaggatggtcttgatctcctgacctcatgatcgcccgcctcggcctcccgaagtgctgggattacaggcgtgagccactgcgcccagccacaatggaatattattaagccttaaaaaggaaggatatcctgccacatgaatgggctttgagcatcttacgctaagcgaaataagccagtcacaaaaaggcaaaattccacttatatcaaggaagtagagtagtccaaaatcatagaaacagatagtagaatggtggtttccagggactagcagcaaggaggaaatggtgagttgttattcaatggttagagacgttcaatttttttttttttttgagacggagtctcaatctgtcgccaggctggagtgcagtggcgcaatcttggctcgctgcaacctctgcctcccggcttcaagcaattctcctgcctcagcctcccgagtagctgggactatagacacctgccaccatgcccggctaatttttgtatttttagtagagacggggtttcaccatgttggccaggatggtcttgatctcttgaccttgtgatccacctgcctcggcctcccaaagtgctgggattgcaggcatgagccaccacacccagccagagatgtttaattttacaagatgaaaagagttacatcctggctaacacggtgaaaccccatctctactaaaaaatacaaaaaattagcctggtgtggtggcgggcgcctgtagtcccagctacttgggaggctgaagcaggagaatggcgtgaacccgggagacggagcttgcagagagccgagatcgcaccactgcactccagcctgggtgacagagcaagactccgtttcaaaaaaaaaaaaaaaaaaaaaaaaaagacaagacaagacttagggcgacacatggtggtgattgttgcacaacattatgagtacatttaatttccactaaactgtatacttaataatggttaacatggtaaattttatgttacatgtattatacaataaaaaatactttttaaaaaagttaagtaattgaggaggtattattaattgtagttacattttacagattggaaagcaaatcccaggcacagttagctgataaaaaagttatttggctgcgtgcagtggcgcatgtccgtaatcccagcactttgggaggccgaggcgggcagatcacttgagctcaggagtttgagatcaccctgggcaacatagtgagacctcatctctacaaaaaataaacagaaaattagctgggtgcagtggcgtgcgcctgtagtcccagctacttgggaagctgaggtgggagaattgcttgagcctgggagatcaaggctgcagtgagctgagatcatgccactgcattccagcctgggtgatggggtgagacactgcctcaaaaaataaataaaaaataaaaaaagttattcaacaacctcaggcaaaacaattttctcttttgttattaactcagctaaacttaaacttctgtatccttcattcagttatacattctaatattaagataatggtcattcaacacctgtgaaaagaaggaaaaaagagataatggtcatagaggaatatgctttctcaaaatgagaaatatctaaggatagaggaaagtgcctacatgttgcctaaagccccttccagctcttaaaccattgtacattgaatgttaacttttccagacatggagttcacttgttctaatgtggaaaaaaaaacagggaaaacttgctaaaaggaatgagataacacaatcataggaatttagaaaagattagacaatatttagtccaagaccattttacaggagaggaaaccaaggcccagaaaggctaagtgatttgctcagaagcctgtggctaaccagtagcatcagagatgacattaaaacccagctctgattctcagggcaatttcctttccattacatgtaggcctccaaacagcaaaaggcaggaagtttggggatcctggttccaccaatcatagacactgcaggacttcttcccactctgaagtatgttggaatcttgtacatattctacacaaacatcaaatttgcttatggtattaacacttgtaatatgcttgcagaaaaatccatattcataacagttatatcttatcaaaatctttttaaacttccatatttgagagatttgacttaaaatattttttggaccaagaatataatctgatagcaccataaatctagagttggttattttttatttatttttatttttttgagacagagtctcgctctgtcactcaggctggagtgcagtggcatgatctcggctcactgcaacctctacctcccaggttcaagcaatgcctcagccacccgagtagctgggattacaggcacctgccagcacgcctgactaatttttgtatttttagtagacaaggtttcaccatgttggccgggcttgtctcaaactcctggcctcaagtgatccgcccacctcgacctcccaaagtgctgggattacaggcatgagccactgcgcccacctttatttattatttattttttttagacagggtctcactctgtcacacaggctggagtgcaggggcactattagagctcactgcagctttgacctccctgggctcaagtgatcctcccacctcagcctctcgagtagctgggactacaggtgcatgccaacatacccaactaatttttgtattttctgtagagatgaggtctctctatattgtccaggttggtcttgaactcctgggttcaagtgatccacccaactcaatctcccaaagtgctgggattacaggcatgaactactgtgcctggcctaggtttggtaatttatttgaaagccataaataaattgaattagcaatatgtaaacaacagaaaaatgtggtaattaatgaagagcaatgaacaatttcaggcccagcaagacctttataatatataactatgattatggttacaatgatgttgataactacatgaaaaattcttaattgtatgctaaataacgcataactatggagaaccttgtacaacacagtgaaaagcagttgaaaaaacaacagcttccgtccagataacaaatctcaaaagataaaacccccaagccttaaaagaaagctaattagctcttgatcaatttaggatttgtgataaaaggaataaatctaggcttttcactatgtccgaagggattagataattgtgctaactagaatagagaacatctaaatcaaggttcaaaaccacaaatgcccgtaagatatggacaggtaatctaaatgtgtgaagaagccagatgggaactgtggtgaagtggggctgctctcagaagcagctgctacttcgtaccatctgggagagagggagaactcaatgttatcagatcttcctatttttaaagacaaatgtaaaaatccggattttcatgcaatataactcaatttttaaagcactggcaatgaaactcaaacactgaaaacaaactaaatctcaaacactaacgtgggccaaataacaaatgcctgcagactggatccagcaagctgttagctagtgacttctgacataaaagttaaaggaataaatttaaagtatattataagcagattcatggaataataagttttctaagctttaagggtccttaaagattcagtttaaccttttcaatttacaggtaaggaaaatgaaaaccagagagttaaaaacaaataaatttgggtcttgagaattacttttatccactagagaagattattcaacaattaccataataagcaacactttatgttcagttcttctatgtacttaaaaagaaagaaaacatgtatatttttaaaatcctaaaattccacctctgtgcttaaattcagccttttgacccaatttaacaagcttgttttgtaaaactcaagataaccatggaagggcaaacatttcaaaaacagtaacaggaagaaaaaataattaaagcaaattacccatgtgtaacaaattgggcacgtttttcaatattgcatctaatttccatttgaagtctttatcatctatatttcctttgaaggccacaaaaattgtggaatcctccaaaatactatcactttttgtgtcatcatcttctagtccagagtcaaaatccatctctgagtcttccattgttgatgaacacaaggaagtatagatgtcttctaagtttggaaggtcatccaaaaccatggtgaatattattccagaagcatatgccaagaggacaataagaaaacttctgaaaagagaagatgcaaaagagcattacaatgcatagttatgcattcaacaatgtataattcatagttctatgaaaattataatttatttaataagaaaatactataaaaattaagaaattacagagaagataagctattttaattatgacattctaaaacaattagttcttacagttaccaaaaataaaaatacactagtcttaaatttaacattctttttattatgttatatgctacttttttataagctagaatgtcaggagaagggaagaaaggatcacaagaaaataaaacaagtacatactttttgagaattataggcctttggttgaccccacagagcaaggggctccccaagactccccctacttctgtcttgacaaaagcttaaaaggagccaaggtttctaaagccttcttctttctccaaactacaaagcacaaccagacctgactaatagcaactggatgattacctaaaattctgaagtctttcatgaaccattttaaacaactattaaagggttattaacagtggaatggctgaaaataatgattctgaaataaacacttaaaaattcttatatgaaagggctgggcgcagtggctcacacctgtaatcccagcactttgggaggtcaaggtgggcagatcacttgaggtcaggagtttgagaccagcctggccaacataatgaaaccctgccactactaaaacacaaaaataagctggacatggtggtgtatgcctgtaatcccagctactagggaggctgaggcaggagaattgcttgaatccaggagggtggaggttgaagggagccgaggttgcgtcactgcactccagcctgggcaacagagcaagactccgtctcaaaaaaaaaagggggttgatatggacaggtaatctttatggaggtaaagaactgtgttccggacagaattaaattgcttcctaaattttagatataaagaagttacattttctgctatcttcaggtatgctgcttaccaaagagtacatgtattaaagatcacacagtgtggccatttcctctgttagtttggggattgaagatcacatacttaacccaaaagtaaatgaatgaacattaattttcagcatttgcggtaagcaaaaatggcatggaaacctaagaacctcccacaaatgttctaataaaataattccttataattttaactataatacaacattgattgattgattgattgagacagagtctcacttttttgcccaggctgcactgcggtggcacaattcggctcactgcaacctccacctcccaggttcaagcaattctcctgcctcagcctcccgagtagctgggactacaggcaagcaccatcatgcctggctaatcttttgtagttttagtagagatggggttttgccatgttgcccaggctggtcttgaacttctgagctcaagcaagccattcaccttggcctcccaaagtgctagaattacaggcgtgagccaccttttatttatttatggcacttatttatttatggcacatgtccagcctttatttatggcacttatttatattattaaagtattacgaattattactttatacttataactataattacaagtttcttaaaaaaaagatggataagaaaattaatcccctaaaaagcaactatattaggttggtaggatcattgataaattttattttcctattttccaaatatgctgcaaatcattaggaaatacaaaactgctgtaatatggttatattccttgcataaatgaaaaaaagtaactcaaacaccgtttaacttttttttttttaatttatttttttgagacacggtctttctctgttgctggaatgtagtggcaaaaacatggctcactgcagcctcaacctcctgggctcaagtgatcctctcgcctcagcttcccaagcagctggggttacaggcgtgtaccaccgtgcccagctaatttttaaaattttttgcagagattggatcttgccatattgcccaggctggtctcaaactcttaggctcaggtgatcctcccaccttggcctcccaaagtgctgggattacaggcatgagctaccatgtccaaccaatttttcttttttaaatagtgaggctggtggatggcttgagggcagcgatttaagaccagcctgggcaacactgtgagaccttgtctctacaaaaaataaaaaaattaactgggtgtggtggtgcatgcctatagccccagctactcaggaggctgaggcgggaggatccctcaaacccaggagttcgaggcagcagtgagctacgatagtgccactgcattccagtatgggtgatagcaacatttttgtctctaaaaataaaaataaaataggctgggcgcggtggctcatgtctgtaatcccagcactttaggcggctgaggtgggcagatcacctgaggtcaggatttcgagaccagcctggtcaacatggtgaaaccccgtctttactgaaaatagaaaaattagctgggcatggtagcaggcgcctataatcccagctacttgggaggctgaggcaggagaatcacttgaaccctggaggcggaggctgcagtgagctgagatcgcaccactgcactccagcctaggggacaagagcaagacttcatctcaaaaataaataaataaaataaaataaaaaaattactactgactaaacttcaacagcaaaggctttccaaaaaccaacctaagcaatccttgggggaaaaattcttctgttataagtaaatatggcaaaaatacttccaaatttgagcagagcaccttgtgttctggcaattatatccttttctagtgctatgactgttacaatgaaactgatttgggtggttaagaaacaacagcagggtcagtggctcatacctgtattcctagcactttgggaggcagaggcaggagtgctgtttgagcccaggagttccagaccaggctaggtaacagcgagaccatgtctcaatttttttaaaaattaaaaaaaaaaaaaaaaagatacaacagcagtcagaaaatctcaaattaataccactgcccttatttgattgccatctgcattttacagatttttaataaactttagaggtaattaaacaaaactaatgaagatttttagggcttaaaagttgctgcttagcaggaaaaatgatgactgcctaaaaaactatgactatttagcagctattccaaagttggaacaactgcaagaaaacatcttaaaatctaagaaacattttccaaaagaatctttaaccagaaaggagactaactaaaaagcctggactttgatagtctccctaaacaggtcgttggtcatgacatgaggactatgtatctagatctggaaaatcttctactggcagatacaggaattgtcagtttaacaatactatgggcattacacagtacttaaaaaaaaaaaaaaaaacagagagaaattgaaagtcagtctatgaaaaattgctggctttccctccagaaaaaataatttttaaagaaacttctttggttggtaggctatttattactgcctcaatttcagaacttgttaattggtatactcagagatttaattttttcctggttcagtcttcctggttcagctgagagtgtatgtgtccaggaatttatccatttcttctagattttctagtttatgtacatagaggtgtttatagtattctctgatggttgtttgtatttctgtggggtcagtggtgatagcccccttatcatttctgattgtgcttatttaattcttttttcttctttattagacctgctagcgatctattatagctagtgatctatcaatttttttcaaaaaaccagcttctggattcactgattttttgaagggtttttcacatctctatctccttcagttcagctctattcttggttatttcttgatcttttgctagctttggggtttatttgctcttcattttccagttcttttagttgagatgttaggttgttaacttgagatctctctagctttttgatgtgggcatttagtgctataaatttcccacttaacactgtttaacactgtcccagagattctggtatgttgtctctgttctcattagtttcaaagaacttcttcatttctgccttaatttcattatttacccaaaagtcattcacgagcaggttgttcaatttccatatagttgtgtggttatgagtgaacttcttaatcttgagttctaatttgattgtgctatgatctgagagactgttatgactaaataggattccctatttaataaatggtgctgaaagaactggctagccatatgcagaaaattgaaactggaccccttccttacgccatccttacaaaaattaactcaaaatggattaaagacttaaatgtaaaacccaaaactaaaaaacttcagaagaaaatctaggcaataccattcaggacatgggcatgggcaaagatttcatgataaaaacgccaaaagcaactgcaacaaaaaaattgaaagtgggatctaattaaaataaagagcttctgcacagcaaaagaaactatcatcggagtgaacagacaacctacagaatgggacaaaatttttgcaatctacccatctgacaaaggtctaatatccagggcccacaagaaacttaaacaaatttatgaaaaaaaaaaaacaaccccattaaaaagtgcgctttcaggtctcccctgcctccaatcttattgtcctccaatctgtctccagacagcagccacagggatctttctaaaacacaaaataggccaggtgtggtggttcaggcctgtaatcccagcactttgggaggctgaggttggaggatcatttgagcccaggattttgagaccactcctgccaacacagtaagaccccgactctacaaaaaaaatttaaaaattaaccaggtgtggtgatgcacacctgtagtcccagctacatgggaggctagggtggcagaactgcttgagcctgggaagtcaaggctacagtgagctatgattgtgccactacactccagcctgggtaagagagcaagttcccgctcttaaaaaaaaaaaaaaaattaaaagagatcaattttggagatggcttaataggcctaggaaacaagttattgaggaaaaacctcaaaacaaactttgccatttacaaattaacctgtatttgatgcaggaccggcaagcctccaaagtggggcttagccttcaagcgttcttggcttcgcccaggagaacttaagggtgagccagggtagggtagaagaaaacagctctattgaagctgcagtgttacaactctgtgactgctcctgcagagcaggactaccccataggcagtgtgctgagactggcagctcagagcagttttgcaattatatttatacctaattttttttttttttttggagatgaagtcttgctctgtcacctaggctggagtgcagtggtgtgatctcagctcacagcaaccgccgccttccaggttcaagcaattttcctgcctcagcttcccagttagctgagactacaggcagatgccaccacgcttgactaattttttgtattttagtagagatggagtttcaccgtgttgcccaggctggtctcgaactcctgagctcaagcaatccgcccaccttggcctcctactgtacctggccagcagttatatttatatctacttttatgtatttcatttattttaatttttttgagatggagtctagctctgtctcgcccaggctggagtgcagtgacacattttagtagagatggggtttcaccgtgttgcccaggctggtcttgaactcctgacctcaggtgatccacccgcctcggcctcccaaagtgttgggattacaggcgtgagccatcgtgcctggcctatacctacttttaagcatgtagattaacaggtggtttatgcagaaattgctagcagaagtatggtaacttttgggtagtcaggtcattgccacggagaggggtggtaagtcttgggtgttgtcatggtaatggtaaactgacatggcacactggtggatgtgtcttatggaaagctgctcctgccccatccctgttttagcagtcctcaatttggtctggtgttcaagccctgcctctggagtcaatttccacctcctacctcatatttaggcttaactgaaggacatataggttttaaagttgaagattaagtaaacagcctgtaattccagcactttgagaggccgaagcaggcggatcacctgaggtcaggagttcaagaccagcctgaccaacatggagaaaccccgtctctactaaaaatacaaaattagccgggcatggtggcacatgcctgtaatcccagctactgggaggctaaggcaggagaatcacttgaacctgggaggccgaggttgcggtgaacatagcgccattgcattccagcctgggtaacaagagtgaaactccgtctcaaaaataaataaataaataaataaatctctttagcaggttgatgttttgccttggtgtgccaatgaattgctagattatgtgtcaagttcaaagcatctgaaaatttcaagttacaacttacaaaaaagtatatactataggttacgtggaagcctgatattaggaaatcaacaattcatctaagtgctgtatgaagcagcatctagaaagctttattcaacaaactttgagggaactatggtagtagtaatgagaaaagttaagtaaatagcagtgatcaaatgcaatttcttcaagtttcaatctatggaagtcaaccaatgacaacaatggtatctttcttactcatctaacaaataatttacctttagaaaaatataaggataaaaaggttattgtaaagccctacaaggaggaaatccaacagtttttctgattactgaggcatcaaatgcctgacattgtatttacaggtatcttgatattgtgtcacaggtttatcagcagttccccaagttcctactccaactttgcataaaggcttactatggctaggtgtgctggttcacacctgtaatcccagcactttgggaagccgaggtgggcagacggcttgagctcaggcttttgagaccagcctggggaacatggtgaaaccccatttctacagaaaatacaaatattagctgggcctggtggtgtgtgcctgtagtcccagcaactcatgaggctgaggtgaaacaatcccttgagcctgaggggagtgaggggaagggtggaggttgtggtgagctgaaattgtgctactgcactattgctgctctgagcaacagagtgagactctgtctcaaaaaaattaaaaatgactataaatactcggtaaatgtcaaagtgttatagtcacacacagcataacaataaaataatattcttcacggcaattattcctgccttaaatggaagaatattcactgaaaaacattaatgtaaaaacaaaatttaagaaaggccgggcgggcacagtggctcacacctgtaatcccagtactttcggaggccaaggcgggtggatcacttgaggtcaggagttcgagaccagcctggccaacgtggcaaatcccatttctactattaaaaaaaaaaaaaaaaattaagaataactctaaattacacatatattcacagcaacattattcacaatagccaaaaactcaaatgtccattaacaggtgaatggataaacaaactgtggtagatacatatagatagaatattatttagatataataaggaatgaagtgctgatacatgctacaacggagataaacctcaaaaactatatgctaagtaacagaagccagacataaaaggtcatatattgcataactccatttatttattttattatttatttatttatttaattattttgagatggagtctcgctgtgttgcccaggctggaatgcagtggtgtgacctcggctcactgtaagctccgcctcccaggttcatgccattctcctgcctcaacctcccgagcagctgagaccacaggcacccaccactacgcccagctaatttttttgcatttttagtaaagacagggtttcaccgtgttagccaggatggtctcgatctcctgacctcgtgatgtacccgcctcggcctcccaaagtgctgggaccacaggcgtgagccaccacgcctggcctattattatttttgagacggagtctggctctgtcacccaggcaggagtgcagtggcgtgatcttggctcactgcaacctctgcctcccaggttcaagtgattctcctgcctcagccttccaagtagctgggattacaggcacgcaccaccatgcctggctaattttgtttgtttttaggagagatgaggtttcaccatattggccaggctagtctcaaactcctgacctcaagtgatacacccgcctcagcctcccaaagtgttgggatatcagccgtgagccaccgcacccggtctaatttgtatgaaatatctagaataagtaaattcacagagacagacagacggattagtggttgtgagcgggaggtataggggatggggaatgggacatcttaatggttatgaagtttcattttggagtgacagacatgttttggaactagatagaagtggtggttgtagtacaatgtgaatctactaaatgccactgaactgttcactttaaaatggctaatttatgttacgtgcatttcaacctgatgcatttttaacaactcagaactcagcccactccatacagaaagtagcacatttaatttcttctcgaaacatgcttttagaaaagtattttccctaggtaatttttcttgtatctttttactgctttaaaatgtcaattgtgcacccatcatgagtattctctaagtagggagcagcagtctttgtcagtcagataaagatttacatagaagagtagctgcttgtggcaacagctctacagtgcttgcttccttctttgttcctaatagcactccttctttcctcctaggatctgggagtgaaggactggtcgtacctcaatgcactgctcaccctggcagaaatgacggccttctgctcctggcacaaagctcttaagtctcagaatgaaagaaaaaaaaactttctagatacaaaaactacttctcagtaacttgcaaatgtcagtgtctttaaggaaaaccagcaataaactcttaaattacatttaatgtaaacaatgactgcttgccagagtagtcacttcaacaaactgagataaaaatctaaggatgttagggcaccaaggcacatacccaaacccctgtcataatactgtacatgaaggaaattctcaaaagaagaaggagagagggcagggagatgatgcaaaaatgttctaatattagcaacttctcatgggcttatgaagcacttctgaagagtcccctgtgccaatttaaacccattatgacatacctcccagtgggggactgccaggatctgttattggagtgctatacaaaagctaggagggagggaaatagaaatttcaagataaaaacagtctaattttttctgggctttagctcacctcagatctaaatacagcatcaaactagagttatgttgagtttgcaactttcaacatatatttctatttttaatcaaaggtatttatttgaagtacaatatcctattatcattttaatcaacataaattctaaaaataagtattgtttactggtctttcattgtcttctacagtgaaacctaagattatcatttataaaaaagatgagaaactacatagtttgtagtaaaaaccccatttaaaaacagaagaatagcatctgtattttattaaatgtctccaagaataataaatgcattctacacagtttttccaaaagagagacagtatcagaaaaaaaaaaaaaagaataagcattaagttggctttattaactctctcgcataaggtttcactcaccaaaatctctttcttaatttttatcatttatccaggtcatcttctaagtccaaagaagctggcatttttagggcttggatttcaaggtagcagcccagcagccaaatcaaaattctaaaaacaaacaacaacaacaacaacaaaaagagagagagagataaaataaaaccacagtattatatagaaattaaagatttctttaatttcataacctatcttttcaacaaaagtcaatgtaaatatcacaagttatcaagtcagcattggcatctttagagaatgttaaaacagggttttcattaagtctacaaagattatcttttctgatttttttttttttttttttttgagacagggtctcactctgtcacccaggctggagtgcagtaacagatcatagctcactgcagctcaacctcctaggctcaagcaatcctcccacctcaggctcccaagtagctgggaccacaggcgcatgccaccacatctggataatttttttgtattttttttggtagagatggggtttcaccatgttgcccaggctagtcttgaacttctgggctcaagcgatccacccgcctgagcctcccaaagtgctgagattacaagcatgagccactgcccccagccttttttgagattttaggccactcatcagcaagcattcaaagattgtagaagcaaaactcacagacttatacaagcatcacttaagaatcataaaactgtcactttaagccttagagccctctctataccttcattcttaattctgtccagattaattaacatcaggtcacactatctgcatatgcttagagcccaaaacaaaatattttgtacacatacaaaatacaagacccgcttttctaacaggatttcaaatttagctttttaaacttgacaaagttttaggtgtaagtttttttcctattttatccataatatctatacattatatttttcattaaattttcagtttaagtcttgaaatatttactgtagatataaaacttatgcatggaacttgcatggtggtgcatgccggtggtcccagctattcaggtgactaaagcaggaggatcacttgaggtcaagagtttgaggttacagtgagctatgatcatgccactgcaatccagtctgggcaagaaagctagatcctgtctctaaaaaaaataataataaagccataagagaaaagattgataagttcaaatgcaaaaaaaaatcaattctgcaaagcaaaaaacattgtaagtcaaaaaaacaacaaactaagaaaaaaatacttgcaatcatatcagtgataaaagaacaaatctccctatatagaatgatatagaaaaaaatatgcataggtatgtgtatgtatatgtgcttatacaggcacataaaataaaaagatcaatttggacaaatgtataaaaatggacacagaatatgatcagaaaattcacagaaaaagaaatacaaacgaacattcaacatatgaaaagatgtttaccctcacacaaaagaagcaaaaaacaatttttcactcatcagattagcaaaactccaaaaatttgataatttactgttcccagcaaggttatggtgaaacaggcactcttattcattgctggcggtagtgcaaattggtacaccagcaattaagtaatgtctttcaaaatcacaattacaagctgggtgtgctggcacacacctgtaatcctgggtacttgagaggctaagacaggaggactacttgaggccaggagttcaaggctgtggtgagctataatagcatctgtaaatagccactgcactcaagtctgggcaacacagtgaaacttcatctcttaaaaaaaattacaattgcataaactattaacctagcaattccacttctggatagcaatcctacagatacacttatcatcatataagatgacgtatgtatagtgttatgcactacagcactgcttgtaatagaaaagttaggaaattacccagatgtccatcaatgggactgatttaaattatagaacatccttaaaaatgaaatgcaaaaaaaaagaaacacagcaagaaggaaaatgctgtctgtgtactgacacaaaaagatctccaagatatatttttgagagaaaaaaaacagagtaaaccattgagtaccttgtgctactttttttggggaaaggggagaaaaaatattttatacatgctagtgctaaaatactctagaaagaaatataagaccaataaaaatggttatcttacaaggtgaatttaaaaaatgatgttataccagagggaaggaagcactcacactaatgaggagtgtgttacaagaacacaggagccagttttaagggttttccactgggcaaatttgagacaatttgagtaccaaaagagaataattactaaaattgatatcatgaataagaatccatgaatctccagcaataactcagagagtgaaaaactttaaaaaaaaacacttcttcccatcattggaggtaactatgacattaatgacttattctgaagattgataattaaagagaaagaaataagcaatttacagcctttttagaagggttcatcctcggtagagcggcaaagctctcttacagaagactaccagttaataaatgtagaagcaaagaaagaatttcaaaatcaccattttgcaaccccaaatgaaataaatgattcaggcaaggacgatcacaggttgctaaaaatcatttttgcatgatcgaaaattgttggaaaacaggttaccacagtgccaaaggatcattccagagattacttccgaattgcaaaggggaaaaactgagtaccattataatgggaagatgtgacagtcaccagcttaacctagtgatcaaactcagcaacaatcagagtgagactcttcatttatgcctcttgatgtgatgtaactttaaatacacagactaagttatgatgtattattaccaaaagtgcctaacctaggtctaaacaagtcttcaacgtaatttctccttcacaggaattcaagagatagagcaacaagaaaaatcacaagaaaacgtaatctgacagaactagaatatggaacttgctacaataaaactggtctggtctcttcaaaaagccaaaatcttgggggaaaaaataggggaaggatagagttctagattaaaagagactgaaagtcacaacaaccaactgcaatgcagaaatgttactcagatctggtttgaagaaaacagtttgaaataattttttaggcagctgggggaaactgaatgtgaactgagtagaaggtattagggcattatttttaattttcttgggtgtggtaatgttatttgtaattaggtagagaatgttctttattcttagaagatgcatgctaaagcacagggttataaagtgtcattatgtctgcagcttgttttcaaattattcaacaaaggtagatattacaaatatggcaaaatgttaacacttgtttaaactacatggtcttcatggtattattgtttcaacttttctatatgtttgaatttttttttttttttttttttttttgagacagagtcttgctctgtcacctaggctagagtgcggtggcatgatcacagctcacagcagcttcaaactcctgggctcaagtaacctcccacctcagccccagagtagctgggactacaggtgcacaaccaccatgcccagctaattttttgattatttgtagagatagggtctccctatgttgcccaggcttatctcaaactcctaggctcaagcaatcctcctgcctcggcctcccaaagtgctgggattataggtgtgagccaccgcacccgacctgaaatatttcatattaaaaaagttagaaccaggtatagcggctcatgcttgtaatcccatcactctgggggtgctgaggagggcagattgcttgagcccaggagtttgagatcagcctgggcaacatggtgaaatcctgcctctacaaaaaaatacaaaaaattagctaggtgtggtagtgtgtgcctgtagtcccagctactcagaaggctgaggtgagagaatcacttgagcccgggaggcagagattacagcgagctgtgattgtgccactgagctccagcctgagcctataagttcgagaccagcccaggcaacacagtgagatattgtttcaactaaaaaaaataaataaaaaattgactgggttttgtagctactcaggagactgaattgggaggatcacttgagctgaggagactgaggctgcagtgtgccatgatcagcattccagcatgccggaattccactgctttccagcctgggcaaaaaagctagcatcccgtctcaaattaaaaaaaaaaaaggttggaagaaaaagaccataaaggtccatgggagctgagggtgagatcgagacttctcactatgtatctttttgaataatgtttttcttttgaaccatgtgaatatattacctattgaaaacaaaagttagctataaataaaacctcttaaacgcttagtatcaatatttctactcttaccccatctcagatatgcaacaacaaaaatgtctcctgctttttatctccttttttgaagggggctcctctggctacatttccccacgagtcatttgactcatgataagaacctggaccatcagccagcatggccaaggagtaattgtgccacctcttcccaaagcccaggcagcacagctcacagctccgggaaagactccttccctctgcttgaggagaggagagggaagagtaaaagaggattttgtcttgcaacttggataccagctcagccacagtaggagagggcagagtcctgaagtccccattctagaccctagctcctggatgacatttctagacataccctgggccagaagggaacccactgccttgaaaggaaggactcagccctggcagcattcatcacctgctgattaaagacccatgaggccccaaataatcagcactgatagccaggtggtatttgctgtggggccatgagtgagactgagacatgctgtcttcaagcatgacccagcacattcccagctgtggtggctacagggagagactccttctgcttgagaaaagaaagaggagtaaaggggccgggtatggtggttcatgcctataatcccagcactttgggaggccgaggtgggtagatcacctaaggtcaggagtcccagaccagcctggccaacatggtaaaaccccatctctactaaaaatgcaaaaattagctgggcgtggtggtgcatgcctgtagtcccagccactcgggaggctgagacagaagaactgcttgaacctgaacctgggaggcggcagctgcagtgagccaagatcacaccattgtactccagcctgggagacagagcttccagcttaggtaccagagacactaagctacaagacaaagttccctttactatttgggctatgtagagcactaagcaggctctcggggtccccaattccaggccttggttcttggatggcattttcattcttttttcttttgtttcctctgactgcatattttcaaagaggctctgggcctgccctgggccagacaagagcccactgtcctgaagggagagtcctaggcctggcagcattcatcacaacctaactcaagagccttcgggccttgagtgaacactggcagtagccaggtggtgcttgccacaggtctggggtggtggcggccgtagggaaagatgcctctgtttgcagaaagaggacgaaaaaacgggaaggactttgtcttgttacttgggtgccagctcagctgcagcagaacaaagcactagatagattcctaaggtttctgacttcaggccctggcttccgaacatctctggacccacccagggctggagagaacttgctgccctgaagggaaggacacagcatggctggctttgccacttgctgactgtaaagccctagggccttgagtgaagaacacaggtgatagccaggtggtagttactacaggccttgggcgagagacccagtgctgtgctggctttaggtctgacccagtgtagtttcagtggtggggtggccacaggggtgcttgtgtaacctctcccctagctccaggtagctcagcatagacggacaaattccagttgtttgggagagagtaagaggagagaacaagagtctctccctggtaatccagagaattattctggattttacctaaaaccaccaaggtggtacctctatgagtctgcaagagccacagttttactacacttggggtgccacctaatgtagatacaaatgcagtgacaagagacctggatcacaacactcaagtccctttgaatactcggaaagccttcgcaagaaagatgggtaaaaacaagcccagactgtaaagactataataaatacctaactctccaatgcctagacaccaacaaacatccacaaacatcaaggtaatccaagaaaacatgacctcaccaaatgaactaaatatggtaccagagactaattccagagagacagagatatgtgacctttcagacagagaattcaaaacagctgttttgaggaaactcaatgaaattcaagatagctcacagaaggaattcagaatcctatcagataaatttaacaaagggactgaaataattaaaaaaatcaagcagaaattctggattgaaaatgcaactgacatactaaagaatgcatcagtctcttaccagcagaattgatcaagaagaagaaaaaaatggtgagcttgaagacagcctctttgaaaatacaaagtcagaggagacaaaagaatgaagcacatctacaagatctattaacagaaaatagcctcaaaagggcaaatctaagagttactggccttaaagaggaggtagagtgaaagagaggggcagaaagtttattcaaatgaataataacagagaatttcccaaacctagagaaagatatcaatattcaagtataagaaagttatagaacacaagccagtttaacccaaagagtactacttcaagacatttaataaccaaactcccaaaggtcaacgataaagaaaggatcctaaaagcagcaagacaatagaaacaaataacaattttaaaaaatacaatggaactccaatacatctggcagcagacgttttagtggaaaccctataggccaggagagagtggtatgacatattccaagtgcgaaaggaaaaaaaatttaccctagaatagtatatccagtgaaaatatcctacaaacatgaaggagaaataaagactttcccaaacaaaagctgagggatttcatcaacatcagacctgtcctacaagaaacgctaaagggaattcttcaatctgaaagcaaaggacgttaatgagcaataaaaatcatctgaagatacaaaactcactggtaatagtaagtacacagacaaacacagaatattataacactgtaattgtagtgtataaactactcatatctcaagtagaaagactaagagaccaattaaaaataataactacatcaacttttccagacagtacaataagataaaaatacaaacaaaaagtttaaaagtggggggaacaaagttagtatgtagagtttttattagttttctctttgtttatgcaatcagtgttgttatcagtttaaaataatggttatgagatattatttgcaaccctcatgataaactcaaataaaaaaatacaacagataagaaataaaaagtaaattaaaacataccactagagaaaatcaccttcactaaaagaaagacaggaaggaagggaagaaggaaaagaagaccacaaaacaaccagaaaaccaataacaaaacggcaggaataagtccttacttattaatactaacattgaatgttaatggactaaattctccaatgaaaagacacagaaagtggctgaatgaacaacaacaacagaaaacaagacccaatgatctgttgactacaagaaacacacttcacctacaaagacgcatacagactgaaaacaaagggatggaaaccaaaaaagagcaggagtagctatacttagatcagacaaaatggatttcaagacaaaactataaaaaagagacaaagaaggttattatataatgataaaggggtcaattcagcaagaagatgtaacaattataaatataaatgaacacaatcctggagcacccagatatataaagtaaatattattagagccaaagagaaagacagaccccaatacagtaagagctggagattttaacatcccattttcagcactggacagatgatctagacagaaaatcaaccaagaaaaatcagatgtaatctgcactacagactacatgaacttaataagatatttacagaacatttaatccaatggctgcagaatccacattcttctcctcagcacatggatcattctcaaggacagaccatatgttaggctacaaaacaagtattaaaattttttttaattgaaataacatcaagtatcttctatgaccacaataaaactaaaaatcaataacaagtgaaattttggaaactatacaaacacatggaaattaaacactatgctcctcaatgaccagtgggtccatgaggaaattaaggaggaaattggaaaatttcttgaaataaattataatgaaaacacaacataccaaaacctgtgagatacagtgaaagcaggactaagagggaagtttatggctataggcatttacattaaaaaagtagaaaaatttcaaataaacaacctaacaatgtatcttaaagaattagaaaagcaagagcaaaccaaactcaaaattagtagaagaaaagaaataaagatgagagcagaaataaatgaaattgaaagaatacacaagatcagtgaaatgaaaagctgcctttttgaaaagataaacaaaattgacaacctttaaccagactaacaaaaaaagagagaagacccaaataaataaaatcagagatgaaaaaggagacattacaactgatacttcagaaattcaaaggatcgttagaggctactataagcaactatatgccaataaattggaaaacctagaagaaacaaattcttagacacatacaatctaccaagattaaccatgaaaaaatccaaaacctgaacagaccagtaacaagtaacaagatcaggtgaaaccctgtctctactaaaaatacaaaaattagccaggcatggtggcacgtgcctacagtcctatctactcgggaggctgaggcaggagaatcacttgaacccaggaggtggaggttgcaatgagccgagattgcatcaatgcactccagcctcggcgacagagactccatctcaaaaacaaaacaaaacaaaacaaaaaacaagatcaaagccataagtaaaagccacaataaaaaagaagcctgggatccaatggcttcactgctgaattctaccaaacatttaaggaagaactaattccaatcctactcgacctattccaaaaaatagtgaagagaatagttccaaactcattctacaaggccaatattaccctgataccaaaagcaaagaaacatcaaaaaaagatgatagacacagtgataaacactaatgcaaaaatcctcaacaaaatactgacaaatcaaattaaacaacacattaaaaaatcattcataggctgggtgcggtggctcacgcctataatcccagtactttgggaggccaaggcaggcagatcacctgagttcaggagttcaagaccagcctggccaacatggagaaacctcatctccactaaaaatacaaaattagcccaggcacagtagctcacacctgtaatcccagcactttgggaggccgaggcagtcggatcacgaggttaggagatcgagaccatcctggtcaacatgggtgaaagcccgtctctactaaaaatacaaaaattagctgggcgtggtggcgcatgcctgtaatcccagctacctggcaggctgaggcagaagaatcacttcaaccagggagtcggaagttgcagtgagccgagattgcaccactgcactccagcctggcaacagagcaagactccgtctcaaaaaaaagaaaaaaaaaattggtgaaaatataaaaacgaaataatactatgatcatatattggttacatattaaaatatatcagttcatgaactgttcgaaacaactaagcaaaatataggtttaattatataattacattattttaaaatttttgcaagtcaaaatgcacatgaactgaaaggcaaaatgcaagttgagagttacacatttttgtttgttttagttttttgagtcagggtctcaccctgctgcccaggctaaaggacagtggcacaattcccagctcaatgcagccaagtgatcctcccacttcagcctcccgagtagatggacccaagtgatcctcccacctcagcctccaccatgcccggctaattttcgtattttttgtagagacagggttttatcatgttgcccaggctggtttccaactcctgggctcaagtgatccacccacctcagcctccaaaagtgctgggattacaagcatgagccaccatgcccagcgatttataaaattagaaatgaaaataatcaatgatcaaaaagcttgctacacttcgtaagtaatcaaagaaaaacaggtcaggcatgatggctcacacctgtaatctcagaactttggaatgccaaggcgactgcatcacttgaggtcaggagttcaagaccagcctggacaacatggtaaaacctcgtctttactaaaaatacaaaaattagcagggtgtggtggcctgcacctgtaatcccagctgctcgggagactgaggcaggagaatcacatgaactcagaggcagaggttgcagtgagccaatacggcaccactgtactccagcctgggtgacagagcaagacttggtctaaaaaaaaaaagaaaaaaaaaacaaaaaaacaaagtgaaatgtgtcttttttcatcaaactggaagatttaaaaataaaataattgtggcaatgtacaatgaaatagattaacatttacattttgcttaaatataagcaaatagaattatccttaacatcttaaccataagcttaacaatctaggaatctaacctaatgaaataactgattttgtggtcaaagatttatattcaaagaagttcatcactgacgggtgcagaggctcacacttgtaaccccagcactttaggaggctgaggcaggcggatcacttgaggtcaggagttcgagagaccaacctggccaacatcatgaaaccccgtctctacccaaaatacaaaaaattagctgggtgtggtggcacacacctgtaatcccacctactaggaggctgaggcaggagaaatgcctgaacccgggaggtggaggttgcgccactgcactccagcctgggtgacagggagaaacaccgtttaaaaaaaaaaacaaaaaaccgtcatcacagcttagacaacacagtgagattccatctctacaaaaataaaatttaggccaagcgtggtggctcatgccttaatcccagcactttgggaggctgaggcaggcagatcacctgaggtcgggagttggagaccagtctgaccaatatggtgaaacgccatcactactaaaaatacaaaaattagccgggcgtggtgacaggtgcctgtagtcccagctattcaggaggctaaggcaggagaatcatttgaatccaggaggtggaggttgcagtaagccgagatcacgccactgcactccagcctgggtgacagagggagaccttgtcataaataaataaataaataaataagcaagctgggtgtggtggcacacctgtggtctcagctactcaataggctgaggtgggaggattgcttggacctgggaggttgaggctgcagtgagccatgactgcatcactgtactccagcatgggtaacagagtgagaccctgtctcaaaaaaaaaaaaaaaaagttcatcaaaatattctgttgatggttcaacaacagaagtggttaaacaatttaaatatactcaaatattgcttcccattgagactaatgtttttgagaatatttaacatcatgagcaatatttatattttaaatataaaatatataaaacatgttacttccgctttctttttcaaaaaaattattttaatcacacataactgtatatatacatggggtacagtataatattttgatacatgtatacaatgtgtaataatcaaatcagagtaattaattagcacatccatcacctcatttattatttgtgttgggaacattcaaaatcctctcttctagctatttgaaaatatacaataaattatttttatctatagtcatcctacagtgctagagaacactagaacgtattcgtcctatccagctataattttgtatccattaaccagtctctttttatccttcccctgctcttcccagactctagtaacctctgttctactctctatttcttataccctttttttttttttttaagacagtctcattctgtcacccaggctagaatgcagtggtacaatctcaccttactgcaacctctgcctcctggtttcaagcaattcttgtgcctcagtctccctagcagctggattttcaggcgcgcactaccacgcccagctaattttcttgtatatttttagtagagatgaggttttgccatattgcccaggctgatctcaaactcctgggctcaagcaatccacccacctgggcctctcaaagtgctaggattacaggtgtgatccaccacacctggcctattctacgatctacttctattgtgatcaacttttttaccttccacatataagaacatatggcatttatctttctgtgcctggcttatttcacttaacataatgtcctccaggctgatgcatgttgctacaaatgacaagatttcattcttttatggtatatataccacattttctttatctagtcatgtactgatggacacaagttgattatcttggctattgtgaatagtgctgcaataaacatgagaatgtagatgtctctttgacatactgatttcctttcctttgaatatatacctattagtgggattgctggatcatatggtagttctcttcttagcttttttttttttttgagacggagtcttactctggtgcccaggccccagactagtatgcagtggtatgatctcggctcactgcaacctccaactcccaggttcaagagattctcctgcctcagcctccctagtactgggattacaggcgcacaccattgtacccagctaatttttgtatttttagtagagacagggtttcaccatagtagcctggctagtctcgaactcctgaccttgtgatccacccgcctcagcctcccaaagtgctgggattacaggcgtgagccactgcgcccagccctctttttggcttttcaaggaacctccataactattttccataatggctgtactaatttacattccaatcaacagtatataatagttgccttttctccatctttttggtaatagccactattttaactggggtgaaataatatctcattgtggttttgatttgcatttcttgatgactagtaatgttaagcagattttcatatacttgctgacaattttacattttctttggagaaatgtctattcagatcaagtacccaatttttaaagtcagactgtttttctactgttgaaacatttcagttccttctttattccagatattaatcccttgtcacatgaatagtctgcaaatattttctcccattctgcaggttatctcctcactgtttcctttgctgtgcagaagctttcttaactggatataatcctatttgccagcttttgtttttgttgcctgtgcttttaaggtcttatctataaaacctttgcacagaccaatgtcctgaagtgtttcctctatgttttcttttagtggtttcatagtttcaggtcttacatttaagtctttagctcattttgagttgatttttgtatatggtgagagataggggtctagtttcattcttctccatgtggatatccagttttctcagcatatgcattgaagagactgtctttttatcaatgtatgttttgggcgtctctgttgaaaatcagttggctgtaaacgtgtggatttatttctgggttctctatggtgtttcattggtctatgtgtctgtttttatgccagtgccatgctgttttggttacaatagttttgtatactttcaagtcaagaagtgtactgcctccagctttgctctttttgctcaggattgctttggctactcaaggtcttttgtggtgcctgccatacaaattttaggattgttttttctaaagaagtctgtggtagacagacttgtaaaatggccaccaattactccagcctcctggtgttcatgcctttgtgtaatctcttcctcctgagtatggactggcctggtgatttgcttctaactaacggactatggaaaatgtgataggatgccactccatgattataaaaaattgtgatttccatcttcctaggagacttgctattcctttctcagctttgtgatgttgaagaagctacatggaaaggaattcagagcaacctccagccatcagccagtgagaaaccaagcccttcaattcaacatcccttcaagaagagaattctgtcaccaaccaagttagtttggaaacagattattccccagccaagcgctaagatgagacaccagccctggctgacaccttgactacctcctgtgagagaccctgaaacagaagacccatctaggctatgccgattcctgacccatggaaacccatgccataataaaaatgtatgttgttttaaactactaaatttgtggtaatctgttatgcaacaataaataactattgtaccctacatggaaatcctgctgaataaactgcctggcaatttccttttttattttttgagatggagtctcgctctgtcgctcaggctggagcacagtggtgcaatctcagctcactgcaagctccgcctcctgggttcacaccattctcctgcctcagcctcccaagtggctgggactacaggtgcctgccactagtcctggctaattttttgtatttttaatagagacggggtttcaccgtgttagccaggatggtctcgatctcctgacctcatgatccgccctcctcggcctcccaaagtgctgggattacaggcatgagccaccgtgcccggcctttttttttagtttttgtttttttgtagaaacagtatcttgctggcggggcctggtggctcatgcctgtaatcccagcactttgggaggccgaggagggtggatcacatgaagtcgggagtttgagatcaccttggccaacatggtgaaaccctgtctctactaaaaacacaaaaattagctgggtgtggtggcaggcgcctgtagttccagctactcaggaggctgaggcacgagaatcgcttgaacccaggaggcggaggttgcagtgagccaagatggtgccactgcactgcagcctggtaacagagcgagattccgtctcaaaaagaaaaaaaaaaaagaaacagtgtcttgctatgttgcccaggctgatctccaactcctggcctcaaacggtcctcctgccctaccttccctggaactctgcccagccaggattcttaaatcaaatcacagtgctggaactgtgcccagccaggattcttaaatcaaaatatttttccctctatttataaatatttatccaaatatttatggggggaaaaaagtcacaggtcacacagtggccagttctgctttagctagcagtggttcccaaacttgtctgtgctttttttttttttttttttgagtcggagtttcgctcttgttgctcaggctggagtgcaatggtgcgatcttggctcactgcaacctctgcctcccggattcaagcgattctcctgcctcagcctcccgagtatctgggagtaaaggcatgaaccaccacgcctggctaattttgtatttttagtagagacagggcttctctatgttggtcagcctggtcttgaacccctgacctcaggtgatccgcctgcctcgacctcccgaagtgctgggattacaggcgtgagccacagtgcccagccttgtctgcactttagatcttcttgagatcttttaaaaattccaaagtccaggccatactcccagggcaatcaaatcacaatctgctggggaagggaaagggacaatggcatcagttgtccaagctccacaggtgatttcaatgtgaagacaggtttgggaaatcactgagctaaagttttatctgtgtgatcaagaaaaagctaattcaagatgacagagagagaggcagctgaatgaaactaactatatacacctgcccttctctgagatcgtaaggtagccttgatttccccctgcaaagttatgaattctgaaaatatcagagagaaggccaaataaatgcttattttgctttttggatttatccatgcctccattcgcctccagaattatgaacaagtgagaaattcacctttttgtcttttcttggtacttttcatggaaccaataaagaattctgccatattacatgtattcaacataactaataagacatgacttgaatgcttttttattaagcagatcttatttaatttagtcagttttgatccaacccacatgccaaatgcagcttgccaaagtaaaataccctatggacattaggatcaaaatgcctcctttttaaaaagtaaagtctatttataatccaatcctttaagttgaaattaggccttttataaattgaatttcatgtattctacagaatcaacagacctgcttaagaactctctgaccactctcagaaaagttagtcagtgggacccctctccattcctcccaggacctaaacaaaaaagaaaaagggcaagaggaagaagagaaacatcagaagaaaagactacatataaacccttataaacctattcaaaataaatttttgtgattggccaaattccttctctctaccactgtttctgctaattttactctagaaagagttgtaaaaggccaggtgctgtggctcacgcctgtaatcccagcactttgagaagccaaggtgggtggatcacctgaggtaaggagttcgaaaccaacctgaccaacatggcaaaaccccatctctactaaaaataaaaaaaattagccaggcatggtggcgcactcctgtagtcacagccactcgggaggctgaggcaggagaatcacttgaacctgggaggcagaggttgcagtgagtggagattgcaccactgcactccagcctgggtgacagagctagactgtctcaaaaaaaaagagttgtaaaagacagatgacctatctacaatttctagtccagtggcttttattaaggaaagcttataatcatcaaagaggctcaatatacttttgaaataccacagtagtggttacacaagtgtgttaattttataattcattaaccttataatttgtgtgcttttctttgtatgttacacatcaattaacacatttttacaatagatacatttgtcctgggcagaatctctgaaagattctaagtaagcaggtatcagaaatagtcaaggttacatgatttgtcctaggtcacagatatagttagctacaaatgaagtccttcatatcactttcctactctttctgttataaattgtaaatatgttgatattattatactttttaatttaacattactttcctacttaagactatgaaaaaaataagtattacaagtgagaactgcaaaaaacaagcaaacaagtaaatagaaaacacatgtcctgggttcataactgtgcactattgaagctattgtaccatccatatgaggaaattaaataaagcctaacgcccatgcaaccattttttttctttttttttttttgtttgtttttgagacggagtctcgctctgtcacccaggctggagtgcagtggtgcaatctcggctcactgcaagctccgcctcccgggttcacgccattctcctgcctcagcctcccgagtagctgggactacaggcgcccgccaccatgcccagctaatttttttgtatttttagaagagtcgcggtttcaccgtggtctcgatctcctgaccttgtgatctgcccaccttggcctcccaaagtgctgggattacaggtgtgagccaccgtgcccggactctgtgcaaccatttcttaacctcaatatcctttttcaaatgctttcaatgtagacatatgtcaaactattagtagtaaaatcaactgtgtacctattcagatagactagcattatttttgatatgaaaatatagggtgatagaacggaaaaagggctaggctgagcattgcagagtgggttttagtcatggctgtcccataaagttgttttatgatttagggcaagacataaatctctctggtctaagagtattaaaatgagaggatgaacaccagagctaggactaaacagaatctcaggttccttccaggtttaagaaaactcaaggactatttaacaacaacaacaacaacgtgtatatatatatatatatatatatatatatatatatgctttcaaaatgcattttacaaatgattatctctattcaaatatgtttaaagtagctttgtaaaataaaaatactagaattcctctggcacctgcttcataaatacaagcatattcttcagcttgtatcaaatgcaaacctctgatctgttgtctaggtgcaacaacctctccctctcagttggctaataataacattgttgattctttatcatcatgagactcttttgcctgcatttaaaaaacttcattttatgaatcaatttcagatttacagaacatgagttatttttatgagaaatatgtatctctcaatatgtaacagaagtctttcttaatttctaataatctactgtaatttgaaaactttccatggatgcatttatttgactaccctttaccaactgcctactagcactctgctaggcactttcctgctcctgaagttactatacaagaacaaaaagactgtggaatggttaattgaaacaacattatttcatgaatgcctccatctgaatattacacttatagtatttaaaaaattaagttggccttgtaaccacacaaccttaaatgtttcaggataacttataagacattgttaaagtgtctaaataaacagttaaatgctcactgttaaagacaatttgcctaggcataactattataagatccaatttcatcctccctataccctttcatgaggtccttataaaactatttcatggtggccgggcacggtggctcatgcctgtaatcccagcactttgggaggccgaggtgggaggatcacaaggtcaagagatcaagaccagcctggccaacatggtgaaaccctgtacctactaaaaatacaaaaaaaaaattagctgggcgtggtggcatgtgcctgtagtcccagctacttgggaggctgaggcatgagaatctcttgaaccagggaggaagaggttgcagtgagctgagattgcgccactgcactccagtgtggcgacagatggagactctgtcttaaaaaaaaaaaaaacaacaacaaaaaaactatttcatgcttattctcagatctggggctcccaagggaaaatttgtgcagctctccagccaaatcagagaaacttaatgctctgaaaggatcaacaaaatgcctgtcaaggtgattggcatttcaatacaacaaccctggtttgctcttggtagggataatagacaatttaagggattaggaaatattaacattaatttttaaacttcaatcctaacttcttagtataagaaacaaaagataaattagtaaaacatgaaacttgagatttccaaaaccactcatcccaacacatattataaacatattataaaccgtaagtcagaggctcagtgagatttttcccacgttgttacataaaaaaaacaaagaaataaatctgtgcccaaattgcaacaaagagaaaaaaaattacaaatgaataatacaaaaacagaaataaaatctagaagaggtcaggcgtggtagctcacgcctgtaatcccagcaccttgggaggccaaggcaggaggactgcttgagcctacgagtttgagaccaccctgggcaacatagggagaccccacttctacaaaaaaaatttaaaaattacggccggtcacagtgactcatgcctataatcccagcacactgggaggctgaggtgggtagaccacctataatgaggtcaggagttggaggccagcctggccaacatggtgaaaccctgtctctattaaaaatataaaattagctgggaatggtggaacacccctataatcccagctactagggaggctgaggcaggagaattgcttgaacccgggaggaggaggttgcagtgagtcgagatcacgccattgcactccagcctgggagacaagagtgaaacactgtctcagaaaaaaaaaaaacaaaaaaataggctgggtgcagtggttcacgcctgtattcccagcactttgggaggccgaggagggtggatcactttaggtcaggagttcgagaccatcttggccaacatggtgaaaccctgtctctactgaaaatataaaaattagccaggcatggtggcgggcacctgtaatcccagctacctgggaggctgaggcaggagaaacgcttgaacccacggggcagaggctgcagtaagctgagactgcaccactgtattccagtctgggcaacagagtgaaactctgtcttaaaaaaaaaaaaaaaaggtcattttggagacaactggagaaacttacagacttaatgttagataatattaagaaattactgttttgttaggtgttaataatggtattgtgtttatgtagaagaatatccttacttgcaggtgatgtgtgctaaaatattaaaggcatagtatcatgatatctttatttttaaaaagtttaacataataaacatattattaaacatatgacaacatgttgaatatagatggtgagtataagggtggttcactgtactattattcctggggctttttctatgttttaaagttttaataaaacatttaaaatatcaaaaaaagcccacaaaactgaagaactgctattatactagaagaaaaaatttatgaaattcaattttaactagtagctagtggcactataaactggtagttgttctgaagaataatctgacaatgtggctaaaaagtgatagcctcagacctaatgaaatcattttagggaatatattctaagaaaaaaactggaagaaaaaagatttataaaaagatgtaacagcgctacaatttagaattgtaaaatagggctgggcatggtggctcactcctgtaatcccagcactttgggaggctgaggcgggcagatcacgaggtcaggagttcgagaccagcctggtcaacacggtgaaatcccatgaaatacaaaatcccgtgaaaatacaaaaattagccaggcatggtggcgcatgcctgtaatcctagctactcaggaggctgaggtaggagaactgcttgaacctgggaggtggaggttgcagtgagctgagatcacgccactacactccagcctgggtgacagagtaagactccatcttggggaaaaaaaaaattgtaaaatataaataaaaacgaactgaaaatcacccaaatgccaaataaccagagtattttagactttggttgtcatatatccattaaaaatgataaatatacagatgtgtagaaaagtacgtcaatatattgccaaatgaaaaaagactaaaaaaacctttatatgaattaaatttgtaaagactgtatgaatatgaaaatgactcagaagttatgtacttgcggtatttaaacataatttttttttgttttttgagacggagtctcactcttgtcacccaggctggagtgctacggcatgatcttggctcaccgcaacctctgcctcccaggttcaagcaattttcctgcctgagcctcccaagtagctgggattacaggcgcacgccaccacgccaggctaatttttgtatttttaggagagacggggtttcaccatgttggccaggctggtcacgaactcctaacctcaggtgatccacccgccttggccttgcaaagtgctggaattacaggtgtgagccacagtgtacagccttaaacataatttttaaaatttcatggggacacgtgctattagaaaaagtataaacaatgcaaatataaaatcaggaagaactgcctgggcacaaataaagaaagcacctgagggctattactgaccacaattcaaatgagtattcacaatttaaatacagtactatcctgggcaaggccaacattgctaccattaaaaagacacaggctgagcacagtggcacacgcctgtaatcccagcattttgggaggcaagagtatcgcttaaacccaggaggttgagactggcctgggcaacataggaagacccattctctaccccaaaaaaaaaaaaagccaggtgaggtggtgaacacctgtagtcccacgtgttcactcaggagactgaggtaagaggatcgcttgagcctgggaggttgaggcagcagtgagccatgatcacaccactgcactccagcctgggtgacaaagcgagactctattttttttttaaataataatttaaaaataaaaagacacagaaaaagagcatatcattagcctggacagtacccagtcttcctcaattctatttgttattttaaaacaatactcagttttcctcaattctttccaatatttttttaaattatggaaaaactgaagaagtttcaaagaaaaaccaagaggtaaagaataggatggaaaagaggtaattttgaagaatggtttgaaatcaaatgaagtgtgacatgactattaacactgaaatatccatggggaggcttttgaatggagaccctgaaaagctgatgtatctctcaatgcccacagatgactcaccaagaagagagggctaacaaaaccctcaaagtttgttgttttacagaagagagatttctttattgtgctggcaaaagttactggcataggaaaatgagggaggctgggtgtgttgtcattgaccatctgtttttctacagggtgtttacttatccatgatcacctgatcatattagaatgtctctaaaacttgactcagttactcaaagcttgaatcaattatctaccatttcaaaattccgcagtgccatcctgctcccacacactggtcactcagcaacattcaaatgtcttagacctggcatccagggccccaagaaagtacgtcggcttcacttctccacaactcctcaacaaaccagcaaatcagacttctcactatttcattacctaaatattccttacattttcctatgtccatcattcctttggttactctctccttaatcccatttgttgcaatcttacccttccattttaataaattttaatttaatgcctctatgttatctcaaacactacctgttatgtgttgacttgtgccccccaatcccatccctgccaaatatgttagtcttaactctcagtacctcagaatgtgacctgatttggaaacagagtcgctgcagaggtaatcaattaagatgaagttactcctactggagtagggtgggacctactagtgaccttataagggaaatttggacacagagacatacagggaaaacgccatgtgacaacagaggcaaagatggagtgatgcagctacaagccaaggagcaccaagaattgatggaaggctcagcctctcaagtaggtgcgattagatgcacatgccagcacgcctggctaatttttgtacttttagtagagatggggttttaccatgttggccaggctggtctcaaactcctgaactcaagtgatccacccaccttggcctcctaaagtgttgggattacaggtatgagccagctatttgggaggctgaggcaggagaatcacttgaacctgggaggcagaggttgcagtgagccaagtttgcaccactgcactccagcctgggcaagggagtgagatgctgtctccaaaaacaaacaaacaaacaaacaaacaaaaaagagcagctgggtgcagtggctcacacctgtaatcccagcactttgggaggccgaggcaggtggatcacctaaggtcaggagttcgagaccagcctgaccaatatggtcaaaccccatctctactaaaactacaaaaaaattagctgggcgtggtggcagttgcctgtagtcccagctactcaggaggttgagacaggagaatcacttgaacccaggaggcggaggttgcaatgagccaagatctcaccactgcactccagcctgggcaacagagtgagactccatcacacacacacacaaaaaagcaaaagcaaaagcaaaagaaaatgtatataaatgggtactacggaactgatattcaacagattcaatatcagtaaaggagctgattaatgggaacttttgttgcctttgtgtgtgtgacggagggggaggggttgcagctggttaatgctaaatacaaactgaaatatctgtttaaagtatgaatgccctctgaatttggtgctcattaatattaactgatatagttaatttattaactgataatgaatattataactgacatagaatacacaattcatcacaaagtaaaggtatggtcctggccttctgctttatagagattgtatatcaaataaagcatatgaccaactctagggctgcattcctccttccatcaaagccatagtatttcatttgtgtatacatctaaatgtaactctagttatttactaattaactcagaatgtttattgagctcctaggcagctactttatgtcctttttagaataaggtgaggtagaaaaagatcacatttaaaaaaataaatgaatataccagacatcaaaataggcagacactggagctgaagggagggaagggggaaggcagagacagacaccagcccagtcctaaaggagcactcacccaatctagtgagaagtaagagagtaaactagctccatatctctcctttctccccatgctgatcctacacttcacaatcaggcttcctttcctaacgtacagctttcatcacatcactggcgaaaaacatttgatgacttcccactacctagtcaatcaagttcaaacttcccagcttggaatagaaatgggtattcaaagccttccatgatttgattatatggtatgcagagattaggaaggcaggctttgaaattagactacctggactcaaatactttctgtatcaattgttagctctcttcttcattttatatgtaaaaagggattaaaaaccagtgcctacctcatcaggttgttgtaaggattaaataaaatgctacttatgaaatacttagcacattatcttgcaaatagtaagcatgcaaaaaatgtgagccattggccaggcatatggcttgtgcctataatcctagcaatttgggagaccaaggcaggagatcacttgagcccaggaattaaagactgcaatgagttataatcacgccactgcactccagcctgggcaacagagtaagaccctggttctatttaaaaacaaaacaaaacaaaacaaaaaaaccctacccaaagaacactggggggaaagaaaagccactactactattaatttttttaagttttatttattttaggttttatctattattgttactattgttcatctccatttccacccttaattccaacaacacccttataacaatcctcttctccaagcaaagtggactctttaccatctcctaaatacccacctctgtgtttatgctttcactcagcctggaaaatacagcactgtctcatctccaagtattaagatactaactattcttggcagcttcgttcacagaccacctctttcaggtaccattctctagtatcccagctccataacacattacagacattcctcagcatagaaaccttggctagattcatcttggtatcttgcagagttctagccagtttccagaatacatggtagggctcaacaaatgtttgagaaaataatacctatatttcctttctcgtccaaccactctcttagacaacagctccacaatacaagtaaaaagagttcttctacagtatttcataaagctggccagctaattttctatcaccaatgtggtaatttctaatacagtacttaatacatagtagatgcctaaatattcaaggagctaagctgaatttcacctcatcttttaatttcatttatcattctattcattatgatcaagtatggctcatccttagaaataggttttagtatttacttgcccacaaactcatctgtcaatttctggccatcccccccaccatcccaatatgtcatttactggtttgggggagacaatattcaatacctcaataaagtaagaatcagaaaattaaatgtctgcagggccataaaaataaagagcaaagcaagacagcaaggcagactatggagaactaggaaacacatctcacctaaaagtttcagctggttaccgctataaatgaatatgggcttgctgttgacagatcttccaatttttcaaggttaagtcagaaactcagaggtctgtgtacatttttaagacattaaaaatattgtgtaaaccaaacaaaatacttatacaggtcaaatccaaccacaggttgccagtttgcaacctctgctacagaagttctctgcaaaagtgatggcgtgagaagagttctatcctagcagataatctaaggcagcccctaaaactaagtagctccttggaagcatctcctgcaacactcagcccaactctcaccattctgattgacctgaaaaccaaattaatttggcaatttaattgagcaaaatgagcccctgctctgtaccaggtgctgaggaatcagaaatgaacagtagtgctaaagtacagctaatatttattgagcatgttctaggtgccaagcactgttttacacgttatgtatattgactcatttaatcctcacaaaaccctatgagattactattatccttaaagactgaggcgcaatgaggttttatttgtccaaggtcacacaatcagcaagcagcagtgcttaataaggacctgagacagactccaccaaaaagagctcacaatttgaaagcaagccccattcaataaatgatgctgggatcactggttatacatagggaaaaaaaatgaaactggacccgaccttacactacacataagaatccattccagatacattaaagatctaaccattgaaaacaacagtaggtattccagaatataaagaataattgcaggctgggcacagtagctcacacctgtaatcccagcactttgtggactgcttgagctcaggagttccagactagcctgggcaacatggcgaaaccccgcctctacaaaaaatgcaaaaagtagcagggcatggtggcgcatgcctgtggtctcaactggcatgggaggtgggagggttgcttgagcccaggaggttgaggctgcagtgagccgagatcgcaccactgcactccagcctcggtgacagagcgagaccctgcctcaaaacaaagaataactgcaaatcttaaaggaaaagattgataaagttgatactaaaattcagaactttttaacaaatgacaccttaaaacagatgttttaaaataagcaacaggccaggcgcagtggctcacacctgtaatcccagcactttaggaggccaagacgggtggatcacttgaggtcaggagtttgagaccagcctggccaacatgatgaaaccccatccctactaaaaacacaaaaatcagccaggtgtggtggcacatgcctgtagtcccagctacttgggaggctgaggcaagagaatcacttgaacctgggagacggaggttacaatgagctgagatggcacgactgcactccagcctgggcgacagagcaagacttcatctcaaaaaaaaaaaaaaaaaaattaaaataagcaagaaactgggaaatgacatctgtaatatctaccaacaacaaaggattaataatcagaatatataaataaatcttttgtaaaagacaacccaataaaaaaaatggcaaaacaagcccgagcattatctaatccgtgtaaagctggcactaccacagttaccacacagtacactccagaacaatagaccttgccatcactgactgatataaatattcaggggtctgtgttatgctgcaggtacacagagcatgggtaatccagcccaaagggcagagccaagacgtttattcattctctatcatcatatagacattggatggcaaattagaggttgaacatccaacactcaaacacatagatcaggggttggcaaatgtttttgtaaagagtatttccagctttgtgagctgacacaacacatctctgtcacgactactcaactctgctattggtaccacaaaagaagatatggacaatatataaataaatgagtgtggctatgttccaataaaacgttatttacaaaaacagatcgtgggccagatttgacctatggaccacagtctgtcgacctctgacatagatagttgtgctttttctacactataggtaggacacttcccatgttttcccctgtcttttatgtctgctgacacctctgatttccttaaccaaaaactacaccacacttgacagctttgcaatggtttccaaaactctattactctgccaaaaaaaccttttcgcccttattatcaatgagaattctcccctcattttcctttcacttttttttttttttttgagacggagtcacgctctgttgcctgggctggagtgcagtggtgcgatctcggctcactgcaagctccgcctcccgggttcacaccattctcctgcctcagcctcccgagtagctgcgactacaggcgcccgccaccacgcccggctaattttttgtatttttagtagagatggggtttcaccatgttagccaggatggtctcgatctcctgacctcgtgatccgcccgcctcggcctcccaaagtgctgggattacaggcgtgagccaacacgcccagacttcctttcacttttttaaacctctttgacagacaccaccccaaaccagaaatttaaaaaactccccctaagccactcacaatgtcaataatcaacacctgcaaattctaactccactcaatgcccacagcctctgccttagttcagatcctcattacttctaactctgctcagtgcccacagtctctgccttagttcagatcctcattacttctaactctgctcagtgcccacagtctctgccttagttcagatcctcattacctctctggtcttcagtctaccctccttccaaagaacatccatttatctcctagaaattaaacctccaccacatactccccttctcgaagatcttgaatgcctctctcagctaaggattcagtccaaactccttagcaaggtccttcacaaccaggttcctaacatggtcttcctagtctcatctctggccatgctttcacacacattctatgctccagccacattcagttattaatacattccctgaaaacgtgtctttacctgaaaggcccttctctccatttcactggcaaattcctgtatcttttaggacacatctcaaatgtcaccccttcgcaacaccttccctgattctttgagcagacacacccatctccgtgtccttatagcgtttaataactcttctttggcatcgaccatcctgaactatgattgttcacatgtctacttcactcatggggctgcatacccaaagtgaagtgactctgccttaaaaacttctgaagctacagagcccagtataatgcttgatatgcagtagatgccttgaggcacagtaaacgtttgctgaatggaagacatgcctggcagtaggagtagggtttcttaacctggggttcatagacaggagtctatagataggacttcagtggggcttgtgaacttggacagggagaaaaaaatctcttttactaacttttaactgaaaattaccattctattcaaatatgagtgtaggtaacataccattctagtattagcagttctgtgactctgtaacaacagaaatctcaaatatctttatatcatactacaattgttgcatataatcttgaagtagcctttatgcgcatcatgtctttgaaattataattatcggatccatcactaaatctgatttcttaacgtgctgataaacaagtatatgcatattagatttgtatattttggaaactgtattttaatataattggtgttccttataattcaatgtactttattttatacaattaaaaaatattattctgaaaggggtccatggcacagataaggtcaggtcttcctgcattagaaaaacccagaataggctgggcgcggtggctcacgcctgtaatcccagcactttgggaggctcaggtgggcagatcacttgagctcaggatttcaagaccagcctgggcaacatgttgaaaccccaactctacaaacagaaaaaaaagaaaagaaaagaaaagaaaaacccagaacaaatgaattgtgttgctgtatatacatatggtattgacagttttattttatatatgcccgcataatatttttgttcgctaattctctttgattatatggggccctggacctattttccatgactaatttgcatatttccttcagaactctcccatagcccatgcgaactttgaattcttctctaacatgatccaacttcaattaataaaatagagactctgggtgtctacaatttttcacttttcttttttaggattttgtgttcctttgtggtaaacacctagaagagaaggagcatctctcttttttttttttctttagacagtgtcttgctctgtcgcccaggcaggaatgtcatggaatgaccatagcatggctcattgcagccttgacctcccaggctcaagcgatcctcccacctcagcctcctgagtagctgggactacaagtacaagccacatcaggtggctaattttttttatttcttttgtagagatggggtctgccagctcctgggctcaagaaatcctcccaccttggcctcccaaagtgttgggattacaggcgtgagccactgtggctggccggagcacctcttaaaactctagaaagttagaaggtctcaaagataacttctttgcacaattagagatgaaccaggaaataccaaataactggctgcctatacttttttgtattcccttcagcctttgtattgccacactcattacaggaagaaaacaaatttaatagttatctggtatatactgttatgcttcatttcttgttgtttttgtttgtttgcttttagtttcatcacaagaatgttatgcttcatttcttaacacctttctcccagctagcaaattcctttaaggcaatgtgtttagtgaggaagcagccgacaatttctagtacccctctgccactaacttgtaagatcttgaaaagtcaactttacctttctatgtttcagctaaaatcactacctgatttgaaatctttacttgatctctcaggcctttgtagtttttatacattcactcttcttcaccattttactggcttcaataacgcctttctgatgacctctccaggtgactctgctcttaagctgtgggctgtccccttccagggaagacaccttgggtcaccgcccccaaacagccaggtccctccttttaaagacacacacaactccctaagttgataaaggttctctccttccttgccaaccagttccactctctgtgcctcttttgctggccagctcctgcacccaaacctcagtctccctttgtcccccttttctctcatcaaacacctcctttttcctgttgcttcccccaagagggggtggaggatgcttgggacataagtcttcagagccttgggagttatacagctttgcaattcagccccagtaccccaaggactgccccaatctgaaccagcgtctgtacccaaagggccctcattcctcatcaatcacctccttccctcccagcaaagaactgctccagccctgacagcctgagcttggcccccatgcctccaccccaatccccaggtcctacctgcattagggctctaacaccgcctaaggcctaacccagttccacgtcctgccatcctctcagcccatagaccccaatcccggttcccttcggacccagtgttccttctccgcgaccctgaccacgaccccacgaccggctcccgcctgttccccaggcctggagcgccaccccgtgcagaccccggccagccctgcactccctcagtgcaccggcccccgcgcccagcaccctccccacccagcccggccgccgctccctccagcgcccccgcccgcaggcctggggcccgctccccaacatggcgacggggacacaagcgcggcgggcggggcggctccgggccgggcccgctctcagaccgtgccactcggtcgcccggcgccatttttccgcgcgggcccgggcggcgcctcctccccgcgaagccagcccgacaaggaccgcggacgcccggcgggcccaccccttacgggcccgcgccgccgtcccctcacctgagcgcggccccggccctcccgggcgggccttggagcgccggcccgggccgtgcgtgcccgccgccctcggtgcgtccgtccgtcagtcctcgcgtgcgcccgtctgtcccgccgcccgcgcccggccgcccgcagcccgacccggcagggcctcacggagccggcggggagggggatgggccggaccgggccggggagggagggggagggagggagagagggagggagcgcgagagggggcggggcggactcgaggggcggggcattgcccacgtgaccagacgtccccgggagcgcgaggtggagcgcgcgccagctcccttcggtgctgagtgcttagtgctgggatctcgtgggtctctgtcggctttccagggctattctctcgccagtgagtcccacttcggaagcacacattgcacagtcttttgcgagcgctctgagtatccttggacatggcaactccaagcctcagtttacccatctgaaatatggggaaaatcatagtgcttgtgaagagcaaatggaggtgggcttggaaagcacttgtcaccgtgcctgacacatactgtctaataataagcttaatgggatatagataaaagctttcattattatttgcctctaaatccctctcttctttttcccatcattacctccctagcaagctaaaatgctcagtaaatagaattattgatcgaacgagtgtggcccctcccctcttcccaaacgtagaaaggcctcctcagcactggacttcatgtctgtcatacaggcctggattcatatctggctttcactcttttttaaaaattttctgttttttcccacactacactgatgtattttttaaattttcgtaagtacgtagtaggtgaatatatttatggggtacatgagattttgatacaggcatgcgatgtgtaatcacatcatggtaaatggggtatctagcaactcaagcatttatcctttgtgttacaaataacccaattatactctagttattttaaaatgtacaagtaaattttgtgtgtgtgtggttttttttttgttttttgttttatttttgtttttttgagacggagtctcactccgtcgcccaggctggagtgcagtggcgcgatctcagctcactgcaacttccgcctccctggttcaagggattcgcctgcctcagcctcctgagtagctggtactacaggcgcatgccaccacgcccagctaatttttgtatattttttaagtagagatggggtttcaccatattggccgggctggtcaggaactcctgacctcatgatccgcccgcctctgcccctcaaagtgctgggattataggcgtgagccaccgcgcccggccaattgttttttactgtagtcaccttcttgtgctagcaaatactaggtcttattctttctaactattcttttgtacccgttaatcattcccacttcccacctacctccccattaatcttaccagcctctggtaaccctccttctattctctatctccatgagttcaattgttttaatttttcgctcctggcccggcatggtggctcacgcctgtaatcctagcactttgggaggccaagatgggcggatcacctgaggtcaggagttcaagaccagcctggccaacatggtgaaaccctgtctctactaaaatacaaaagctaggtgggcatgatggcgggtgcctgtaatcccagctactcaggaggctgagacgggagaatctcttgaacctgggagatggtggttgcggtgagcctagctcgcgccactgcactccagcctaggtggctgagtgagactccgtctcaaaaaaaaataaaaaatagttaattttttgctcccacaaataagtgagaacatgtgaagtttgtctttctgtgcccggcttctttcacataacataatgacctccagttccatccatattgttgcaaatgacacgatctcactcttttttaatggcggaatagtattccattgtgtatatgtacattttatttatccattcatctgttgatggacacttaggttgcttccaaatcttggctgttgtgaacagggatgcagtaaacatgagagtgcagatctcttccatacactgatttcctttctttccggtgtatacctaagaatgggattgctggattgtatggcagctctctttggctttcgctcttgatagctgtccttgcctctctgaacttgagcatcttcatctgtaaaatgggagttggggtctgttctgagcatcccaggagatagaggatgagcaggtggattgtaaactaattaaacaaatcagtcctactgatcccatagaagaaagggagtcaggaaccctttcattccatcaatatttattgagtacacacagtgtgcttggactggtgtagtagatacccaccatcttttcacattaccctgaccgccctctaatctattctccaccctgctgtcagagtaatgtttctaatgatcagaaatatgatcatgtcactactctacttaaaagtatctgttgatggccaggtgcagtggctcacacctgtaatcccaacactttgggaggctgaggcaggtggattgtttgagcccaggagttcaagaccgggctgagcaacatggcaaacgctgtctcaacaaaaaatacaaaaatggctgggctcagtggctcatgcctataattccagcactttgggaggtcgaggtgggtggatcacgtcagctcagaagttcgagactagtctgggcaacatggcaaaaccccatctctactgaaaatacaaaaattagctgggcatggtggtgcacacctgtagtcccagctaatcgggaggctgaggcatgaggcaagaatcacttgagctggaaggtggaggcttcagtgagccgagataacaccactgccctcctgcctgggtggcaaagggaaaccgtgtctcaaaaagacaacaaaagacaaaaacatagcaggcatggtgctgcacacctgtggccccagccactttggaggttgaggtgggaggattgcctgagcctgggaggttgaggctgcagtaagctaagatcatatcattgcactccagcctgggcaatagagtgagaccctgtctcaaaaaaaaaaaaaaatctgatggctctacattgctcttaagataaaggccaagccgggcgcggtggctcacgcctgtaatcccagcactttgggaggccgaggcgggcagatcacaagatcaggagatcggaccatcctggctaacacggtgaaaccccgtctctactgaaaatacaaaaaattagccgggcgtggtggcaggcgcctgtagtcccagctactcgggaggctgaggcaggagaatggtgtgaacccaggaggcggagcttgcagtgagccgagatcgcgccactgcactccaggctgggcgacagagcgcgactccgtctctaaaaaaaagataaagaccaaataaatgttggcctccccacatctctagatttatcttagggccctcttcccctttctctgggttgcaactacagtgatatttcttacacattgttctccctcctttctgagaacccttgcacatgctgatccccctgcctgcaatgctctccccacttagataactctcagtcttcagatcccagttcaaacggggctactccaaggataccttccctgacccattcccacacaggttttcttagcacgatatgcttgtccttagtagaatacactgagtcattattacctgtctttgccactagactatggacaccataaggaagaaaaccttatccatcttgtttaacattgttttctcagcatatagcacagcacctggcacagagtaggtgctcagtaagtatttgttgcgtttgtgaatcctaagcacaatactaggtattgggcccaagagggcagacaggagcaaagagaaccacaggcaaccgcaacaggggggcaccttagacctttgagcctatgaaattaacaccaaataaatttaaaatatcctggaaaaaaaaacttttctgaagctttttattttaacttttaaaaactgaaatataatttatatacaataaaatgaaaaactattaagtgtatatctaataatttttttgcctacattcctgtgttaccaccacctagatcaagttatagatctatcaacccagaaagttcccttttgttctcttttgtatgttctcttctaataaatacctgctcccccagatgtaaccattattctgacttctagcaccatagattaactttttttttttttttgagatggagtcgcgctctgtcgcccaggctggagtgcagtggcacaatctcggctcactgcaagctctgcctcccgggttcacgccattctcctgcctcaacctcctgagtagctgggactacaggcacccaccaccacgccaggctaattttttgtatttttagtagagacggggtttcaccgtggtctcgatctcctgaccttgtgatctgcccgccttggcttcccaaagtgctgggattacaggcatgagccaccacgcccagccgtagattaactttgacagtttttgatctccatagaaacagaaccatacagtttgtactcttgtgttagcctggaaatctgacatagccaaagggtgattttttggataaagatacaattaatgaatgacttgattaattaacctgaaagactgaatgaaaagctctggctacttcatcctacagacacagaggtcctgacaacagccagcccagaggctgagaagacctcactgacatatttccaaacccacaaagacttctagagataagaaagctctcaaagattccagaaactcagcaataagactgggtgctatggctcatgcctgtaattccagcactttgggaggccaaggcaggaggattgcttgagtccaggagtttgagaccagcctgggcaacacagtaagacttcatctctacaaaaaatttaaaaattagctggtcatggtcgtgtgtgcccgtaatcccaactactcatgagactgaggtggaaggatcacttcagcctgggaattggaggctacagtaagccaagatcacatcactgctctccagactgggtgacagagtgagaccctgtctcaaaaaaaaaaggcaaaggacttgaatagacatttcttcaaagaagatatacaaatggctaataagcacatgaaaagatgttcaatctctgtagtcattaaggaaatgcaaatcaaaaccacaatgagataccaattcataccctatttatgtatgtatgtatttatttattgagacagaatctcactctgtcgcccagactggagtgcagtggtgcgatctcagctcactgcaacctctgcctcccaggttcaagcaattcttgtacctcagcctctgaagtagccggaattacaggcgcgcaccaccatggccagctaattttttgtatttttagtagaggtggggttttgccatgttgtccaggctggtctcaaactcctgagctcagtcattccccctgccttggcctcccaatgtgttaggattacaggcgtgagccacggcgcccagctgctgttatttttttaaaaggcagaaaataacaagttttggcaaagatgcggagaaattagcacttttatgcattgctggtgggaatgtattttgtttttgttttttgtttttctttgagacgatctcgctctgtcacccaggctggagtgcagtggtgcaatctcggctcactgcaacctccgcctcccgggttcaagcaattctcatgccccagcctccagagtagctgggattacaggcatgcgccaccatgcccggccaatctttgcattttctgtagagacagggtttcaccctgttgcccaggctagtctcaaactcctgggctcaagtgttccacctgccttggcctcccaaaatgctgggattacaggcgtgagccactgcgcccagccaggaatataaattgatgcagccatggtggaaaacagtttggcatttcctcaaaaagttaaacataggcgcccctgtaatcccagctacttgggaggctagggcaggaggatcacttgaacccaggagtttgagtccaccctgggcaacatagcaagacccagtctcaaggaaaaaaatgttaaacataggattaccctatgagccagtaattccacttctgggtattcatccaaaataagtgaaatcacattagtaccactgtactccagcctgggtgacagatgagaccctgtctcaaagtttaaaaataaataaatgaacaagccaggtgtggcagcacatacctgtggtcccagctacccaggaggctaaggcgagaggatcagttgagcccaggaggttgaggctgcagtgagccatgtttccattcctgcattccagcctgggtgatggagcaaaaccctgtttcgaaataaaatttaaaaaataaagaagtgaaagcagagtttcaaagagatatttgtgcacccctgttcacagcagcattgttcacaatagccaacatgtggaagcaacctacatatctatagacagttgaatagataagcaaaatgtggtctatacatgcaatgaagcatcgctcagccttcatgaaggaaggaaattctgacccgacgtacaccacagatgaaccttgaagatattatgctaagtgaaataagtcggtcacaaaaagacaaatattgtatgattcctcctatatgaggttcctaaagtagtcaaattcataaagacagaaagtagagtggttgccaagggctagagggagagggaatgggaagtttgtgtttaatgaatacaaagtttcagttggggaaaacaaagttctggaggtagatggtggtgatggttgcatgtgaatatacttaatgccaccgaattatatgcttaaaaatggttaaaatggcaaattttatgttatatatgtattttaccatacacacgcacaaaagattccagagccactatcctaattttttcaccttgttgtccatgtccttaagccaagggtcatgggtgttcctgggatctgcaagaatgcaaagagctgagaagacaggggcgcattgggcacctgcagatcctgtaggtaaaaatagcaggagcctaggcaacacaaatacttgttgcctgcaggcaggcagcaaaagaacaaaaacaggccataaactagcagatagtatagcataatgattacaatattgggctctgaagccaaagtgaatctgaacacccaagttcagattctagctctgccatttattagctatgtgaagaaactgcaaccaaaaggagataaatgacttgtccaacagggtccaaagtattttctcatttatattgtttaaaaatctttacatgggttttgtttcattctatatccccagtagactgtaagctccccaaggaagctatgtttgtaatatcctcacttgaaatgtaacttaacttctttgtgcttcagttgcctcacctgtgggatgcagagaataagggctcctacttcataaggttgtcaagcatattaatgaatttatacctataaatgtttaggagaaagcttagtgcttatgatagtctcaacaagcaatagattgagagaggcttctgaagaggtggtcaggctatttcataaaatgttttgagcaagaaaaacagtcctaaaacatccaggattgttctagatttggactagagtgaagaaaaagcaaatcaattgttctttgataatttgatttgtatttattggacttctactttcatgtgtgtccaaacaggctcaagctctgcagtgataagactgacagtgaatacttcaatgatgtctttaagaaaaacaataataaaacaggggaaaaaagaaagaacaaaaccatctagaaagtgtcaacattttactgtctgcagggttcgtcacaacagtgccaaatgacaaacttaccacatttagttggatgaattttgccctgcagaaggatatcaccttttttttttataggcaaacagtttatttattcatcctccttctcttcctccccatcttcttcatcttcttcttccatcttttcccaggcaactttagcaggaccttttgtgccgtccaactttcctttcgacttatagtcagcaacatccttctcatacttcttcagctttgccaccttagtgacataaggctgcttttcactgtcatttaagttattccacatctcacccagcttttttgccacgtctccaatagagatgccagggtttgtggatttgatcttggggcagaattctgaacagaacaggaagaatccagacagtggccttttgggggcattaggatcgttcttgcctcccttagctggtccataatccttcatttctctatcacagtgcactttatccgcctttgccatttaatcgaatttagactctctctctctttttttttttctgagatggagttttgctcttattgcccaggctggagtgcagtggcacgatctcagctcaccgcaacctctgcctcctgggttcaagccattctcctgcctcagcctccccagtagctgggattacaggcgcccaccaacacgcccggctagttttttgtatttttagtagagacgaggtttcaccatgttggccaggctggtctcaaactccttacctcaggtgatccacccaactcaccctcccaaagtgctgagattacaggcgtaagccgccgtgcccagcctagacttctctttcccagacattgtcttccacctctcagagcactttttggaaaattctgcaaaattgacagggacctctggatttttcttatgctcttctctgcacgtctgcacaaagaaggcaaaagcagacatcttgccccttagtttcctggggtcacttctagccatcctgactgtattgttcactagtcttgaaggatatcacttttaagtggacaccattcacatgacattataatttgcaaatttattatgataatttaccagtagatggcagtaaaatgccttgttatttcagaatctgttcgttgtaacaattttcagatatatggaaataaaatgccttgaggagggggtcacttgtgctttgcataaagacatgctatggcgaggcgcagtggctcatgcctgtaatcccagcactttcggaggtggaggtaggtggattgtgtcagcccaggaattagggaccagccagggcaacatggcaaaaccccgtctctacaaaaaaatacagaaattagccaatcgtggtggtgcatcatgcctgtagtcccagctccatgggaagctgagatgggaggatcacttgagcctgggaagcagaggttgcagtgagctgagactgcaccactgcactccagcctggatgacagagtgagactctatctcaaaaaaaaaaaaaaaaaagcggtggtggggtgggggcttactatgggcaagccatggcttgctcttcaggaaaaaaatcattgaaaaaatagaagaaatagactaataattacacaattttaaaaagtggaagaatatcaagtgaccatacatacacaaaaaggtgggggtgggggagaaaaaaaaaactgttttcaaaaatattctgaaattttaaagctttttattagagtataatataaagacataaaagtacagaaatcgtaagtgtaaagcctgttgaatttccacaaagccaacacacatgtctaacaaacacccaaatcaagaaatagaacattcagccccacagaagccccttccagtcattacccacagcccccaaggttaaacagtattttaacttctaactccatagattagtctcaccaggagttaaacttacagattcatctacattgttgcatgtagttgtagcatgttcattttcattgctgggtagcatttcattatttattttttatttttttgagacagagtcttgctctgtcacccaggttggagtgcagtggtgggatcacaggtcactgcagccttgacctcccaggctcaagtaatccttctgcctcagcctccctagtagctaggaccacaggtgcatgccactacaccatgctaatttttgtattttttgtagagacggggtttcaccatgttgcccaggttggtctcaaactcctgggctcaagtgatcctcccacctctgccacccagagtgctgggattacagatgtgagccaccacacctggccagcattttattgtttgaatacaccataatttatccattctactgttaatgagcatgtgggtttccacttaggagctattttattttattttatttattttttttagagatggactcttgctctgtcacccaggctggggtgcagtagtgcgatctcggctcactgcaaccttcgcatccctggttcaagcaattctctggcctcagcctcccgagtagctaggactacaggtgcacgccaccatgcccggttaatttcttttgtattttttagtagagacagggtttcactgtgttgcccaggctggtctcgaactcctgagctcaggcaatctgcctgcctcggcctcccaaagtgctaggattacaggcgtgagccatcacgcctggccagagctttttttgttttgttttgagacagagtttcgctcttgttgcccaggctggaatgcaatggcgtgatctcggctcactgcaacctctacctcctgggttcaaacgattctcctacctcagcctcctgagtagctgggatcacaggtgcccaccaccatgcccggctaattttttatatttttagtagagacagggtttctccatggtggtcaggctggtctcaaactcccgacctcaagtgatccgcccacctcggcctcccaaagtgctgggattacaggcgtgagccaccgcacccgggccggagttattttaaattttactactatgaacattcttgtgcatgtctttggatgaacatgtgtacaattttttgctggataaaaacctaggactaggattgctgggtcatagagtttgcattcagctcttagctcatattaccaaatcctatgtctttttaaaacagttttattgacaggctgggcacggtggctcatgcttgtaattcaagcacctttggaggctgaggcgggtggatcacctgaggtcaggagtttgagaccagcctggccaacatggtgaaaccccatctctactaaaaatacaaaaattagctgggcgtggtggcgggtgcctataatcccagctactcgggagattgagggaggagaattgcttgaacctgggaggtggaggtaacagttagcagagatcccgccattccattccagcctgggtgacaagagtgaaactctgtctcaaaacaaaaatcaaaaacaaacaaaaaacaattttccaaaacaaaacaaaaaaacagcttttgagatataattgacatactatacaatttactcatttaaagtgtattattcagccgggtgtgtggctcaagcctatgatcccagcactttgggaggttgaatcggttcgctcacatatgtccaggagttcgagaccaggctgggtgacatggtgaaaccccatttctacccaaaatacaaaaattagccggacgtggtgctttatacctgcagtcccagctattgtggagactgaggtgggaggatcacttgagcccaggaggcggagtttgcagtgagccaagactgcactattgtgctccagcctgggctacaaagccagaccctgtctcaaaaaaaaaaaaaaaaaaagtataattctatggtatttagtgtagtcacagatatgtgcaaccatcaccacagtcaattttagaacattttcattgcctcagaagaaactctataatctttaggtatctccctctccccaacccccccattccctcagccctaaggaatcactaattgactttgtctctgtcagtttgcctattatggatacttcatataaatggaatcatacaatatgtgaccttttggcttctctcacttggcacaatgttttcaaggttcatccatattgtagcatgtatcagtatcagtactttattctttttcatagctgaataacataatatgtattattatgtgaatataccacattttgttatctttttgtctgttgatggacatttgggttgttttttaccttttggtattgtgaatagtgatgctatgaacattcatgtacaagtttttctttgaacacctgttttcagtgatttggggtttatgcctgggaatggtattgctgggtcgtatggtaatttggtttgtcttattaaagaaatgccaaactgttttccatagctgctgtaccattttacatttccaccaacaacgtatgaagattccactttttcacatcctgagcaacatttgttatttcctttttaaaaaattattgttgtgggcgcacagtggctcacacctgtaatcccaacactttgggaggctgaggcaggaggattgcttgaggccaggagtttgagaccaacctgagccacatagtaagactccatctctatttaaataaaagataaaaaataacatttaagtaaataaacaaataaaaataatatttatggccagtctaattgttgtgaagtggtatctcatggtgattttgacctgttttaatctacatttccctagtgattatgatattcagcatcttatcatagacttatctttgaagaaatgtctgttgaagcccaggcacagtgacttacacctgtaatcccagcactttgggaggccaagatgggaggattgcttgagtccaagagttccagaccagcctaggctgcatggcaaaaccccatctctacaaaaaatacaaaaattagctgggtgtggtgacatgcacctgtagtcccagctactcagggggctgaggtgggagaatctcttgagcctgggaggtggaggttgcagtgagccgagatggtgccactgcactccatcctgggtgacagagtgagactctgtctcagaaaaaaaaaaaaagtgtcctttttgttttgttttgttttgaggcagggtttcactcctgtcacccaggctggagtacaatggcacgatctcaactcagtgcagcctcgatctcctgggttcaagggatcttcctgcctcagcctccccagtagctgggactacaggcacgtgccacagcacccagctaattttttatatttttggtatatacagggtttcaccattttgcccaggcttgtcttgaactcctggactcaagcgatctgcccaccttggcctcctaaagtattgggattacaggcatgagccactgaaccctgccaagaaatgtctattgaagtcctttgcccatattttaattgagttgtttgtctttatgttgttgaagtgtttttaatatattctgggtactatataaagtactcagatcagatataagattgcaaatacttttcacattttttggactgtcttttcactcaagattgtccttttatgtacaaaactttttaatttcaatgacatccaattatctatgtttgcttttgttgctgtgctttcggtgccacatctaagaaaccatttgccaaatccaaggtatgaggatttacccctatgtttccttctaagagttttatagttttagctcttatatttgtgtctttgatccattttgagttactttttgtatgtggtgtgaggcaaggttcaaacttcattttgtgtatgtgaatatgttaaagagaatattccttcttcattgaatgatcttggcaccctagttgagatcaattggccatagatatattgatttatttctggactatcaattatgttccattgatatgtttatccttatacctaccacactgttttgattactttgtagtaagttttaaaatcgggaaatgtgtgtcctccaacattgttctttttcaagattgttttggctattctgagtcccttgcaattaattccatatgaattttaggatcatccatattcatttctgcaataaagtgctgctggaatttccatacagattgcattgaatctgtagatcaattgggaagtattgtcatcttaacaaaattaaatctttcgattcataaacacagaatgtctttacatttatttaggtcttctttcatttctttcgacaatgttttatagttttaatttttatacttcttttataaaatttattcctaagtattttattctttctgatgcttcagtaaatggaattgttttctttcttttttctttttcttttctttttttttttttaagggtctcactctatcacctaggctggagtgcagcggcgccatcaatccaccttctggcctcaagctattctcccacctcagcctcccgaggagctgggactataggcacacaccaccactgtcagttaatttttgtagagacaaagtttcaccatgttgcccaggctggtctccaactcctaggctccagcaatcctccagcctcagtctcccaaagtgttgcaattccaggtgggagccactgtgcctggccagaattgttttcttaatttcatttacaggttgtttattgcaagtgtacagaaactttatactgatcttgtattagcaatcttgctgaactcctttgttagctgtcattgttttcattgatttcttaggattttttgtatacaagatcatgccatctgcaaataaaaatagttttactttttactttccaatctggaggccttttacttctgtatcttgcctaattgccctgactagaacatccaatacaatattgaatagaagtagcaagaatgggtatgctctaatcttagtgggaaagcatccaatctttaactattaagtatgatgttaactgagggttttttatatttgccttttatcatgttgaagaagttcccttctattcctggtttgctgagtgttttttgtttgtttgttatcatgaaggggtggtaggattttgtcagatgccttttctgcatctattgagatgatcatgtgttgttttttattctaccaaaaaaatataatgcaatacttgatttttgaaagtaaaccaagcttgaattcctggaatgtatcccactgaggcagtgtatacttctttttatatgttgttggctagtattttgttgagtatgttacatccatgttcataaaagaatattggtctgtagttttcttattaggtcttattttgttggattttaatttcaaggtaaaactagcctcacagaataaactagaaagcgtttcttcctcttctatttattgaaagctttttttatagaattggtattaatttttttcaatgttttgtagaaatcactagtgaggccgtctgagacctgggcttttctttgtaagtagtttgctttttagtatatattactaatctctttatttgttatgtatctcctcagattgtctatttcttcttgagtcagttttggtatgtgtctttctaggaaattttatgtttcatctaagttatctgatttattaacatacagttgttcatagtatttctttgtgatccttttttatttctgtaagattgtaagtactgtcccatctttaatttctgattctagtaatttcgagtcttctttttttcttgatcaatctgggacaggtttgtcaattttgttgattttttcaaagagccaggatttggttttattgattttctctattgtttttctattctctatttcactaatctctgctccaatctacccagtttatgatattttggtatggcagcccaaatgaactaagacactctgtcacttgaaagacagcctgggagagtaggtatgactacaggcatggctcaggcacctaaagatatcagggcaaggatcacccaaacatccatcaaaaggaaactggttaaacccttcagtgaactacgatgcattattataaataatgaagtggatccatatatattaacaggggaaaatgcccacgctctattggtaagttaaaaaaaaaaggaagttgtagacagtgtgaaaatatagtcccatttttactttttaaacagaatatatgttagtgtacagaaaaaagttggaggaatgtgtattaaattattgacaatgagatttttggagggtttggattttgaaggggtggattacagatatacattatatatctataaagtatttgatatttgaaaaactgttatatctgcaatccaataaaataatttaaaaatttttaaagaagtggccaggcacagtggctgaagcctgtaatcccagcactttgggaggccaaggcaggagaatcacttgaggccaggagttcaagatcagcctgggcaacatagtgagactcttgtttctacaaaaaaatgaaaaattagccaggtgtggtggtatgcgcctgtagtcccagctacttgggagtccgaggcaggaggattgcttgaccaggaaagttgaggctacagtgaacagggattgcaacactgcactccagcctggatggcagagtaagaccctatctctaaaaaaaaagataaagaaacgaaggggagggaagggaagggaaagaaggggaaagaaagggagggaaggaaggaagaaagagaaagaaggaaagcaaaagagagacagtgagacagaggggaagggaaggggaggggaaggagaggggaaggagagagcaaggagaggggagaggaggggaggagagggaagggaagggaaacatagtctatggagtcgaacagatggcttttgaatcatggatctgtgaaaggaggggaaggaagggagaaaagaagaaaagagaaaggtaggaaggaaggaaaggaaaagaaaaagaaagaaagaaagagacatagtctatggagtcaaacagattgcttttgaattatgcatctgccaactaccagctgggtgatctctggtaagttgcttcgggtctctcaattttctcatcaataaaatgggggaattaataccagcctcataagaatgagctacctatctcaccagtttcatctcatctcatcatcccctcggggtgctctagtgtaggggtcagcacactactgcccttatagcagtaagggtctggtttttgtttgtttgtttgtttgttcttgagacggagtctcgctctgtcacccaggctggagtgcagtggcgcaatctcggctcactgcaagctccgcctcccgggttcacgccattctcctgcctcagcctcccgaatagctgggactacaggcgcccgccgccacgcccggctaaatttttgtacttttagtagagacagggtttcactgtgttagccaggatggtctcgatctcctgacctcgtgatccgcccgcctcgtgcctcccaaagtgctgggattacaggcgtgaaggggtctgttttcagaaaataaagttctggcggggcgcggtggctcacgcctgtagtcccagcattttgggaggccgaggtgggcggatcacgaggtcagaatatgaagaccatcctggctacacggtgaaaccctgtctctattaaaaaaaaatacaaaaaaaaaaattagctgggcgtggtgggctcctgtagtcccagctactcgggaggctgaggcaggagaatggcgtgaacctgggaggcggagcttgcagtgagctccacttgcaggcagagcttgcagatcgcgccactgcactccagcctgggcaacagagcgagactctgtctcaaaaaaaaaaaaaaaaaaaaaaagaaaagaaagttctattggaacacatccacagccatcaggatgttgtcttacacattgtctatggctgcttttgcacttcagcaacaaagttgagtaattactacaggaaccatatgacctacaaaatctgaaatatttactctctggtcctttgtaggaaaactctgccaacccctgctctaggaagaatatataggccttctttcacctcctaaaacatgacacattccttctcaccacaatacctttgaacatactgttccctttgcctagaatgacattcccacatcccatatctaatcctttcctgtcaatcctattcattctcatgaccttctcagggaagcttttgcggatcctcaaactagattaactttcttgatatacattctcttagtatccctcatagagtttattgtgatggcaattacccgaattatctgtgctcttatttctttaacatttgactgccccgatagactgcaaacccattaaaaagtctgtcttggctaggcgcggtggctcatgcctgtaatcccagcactttgggaggctgaggtgggcggatcacctgaggtcgggagttcaagaccagcctgaccaatatggagaaaccctgtctctactaaaaatacaaaattagccaggtgtggtggtgcacgcctgtaatcccagctactcaggaagctgaggcaggagaatcgcttgaactggggaggtggaggttgcggtgagctgagatcacgtcattgcactccagcctgggtgacaagagcaaaactgtctcaaaaaaaaaaaaaaaagaaaagaaaagcctgtcttgttcagtgctgaatctctagtgcctaacaaagtacctggaatgtaatggatagaagaatgtatgcatgaatgatattatctataaaaggtatttattgtctgatatatactatatgacgtatactttataacaaagagttcaactaataggtgtggaattggttaagagcacaaattccagagttggacatgctgagatgaaccccagttcttccatttaatagatgaagaaccttagacaagtcccttaacctcttttggcctgtttcccatctgtaaaatggcaataatattagtacctacttcatgaggcttgtaataaagattagatgctatatattatagttattggtgttatgaattattattattggtgcatgtcttagctggacagatattattatgagtccttcaacgttgactccaggttactcttgaatcggttactgggacagggtgagccgaggtctcctctcccactcccactctcaacccagttaaatataaattaaaccagagccatggttaagcaacattctttctttaatttccctttgcaaatggaagcccctgagctggtgcccacccccacccctaccccataccctggggacccccgatgcaaggcccccacctcaacctggtgggaaaagaggagcaccccctccctatgatggtccattaaaaaattcctagtcatttaagaaatgaggctgggaatgggagaaaggaactggaagacaaggcccaggtcaggccagtctgaagatgttggggttgtgagacccttgagaagggtttgcaagcacatccctaagctcggggccagcatggctgaaggaggagaggtgacacacagacagatagtctgattcctcaaggtcctgcctgcctggctgtactgtagatgctgacactcaccaccaccaccaccaccaccaccaccaccaccaccaccacaggcctcctgatggagaattttccagttactctgggattgggtttgctaagcatcccctctggcccctgatctggggcatccctggggtccccctgagaccaaacctgggagaaggagggactctgggaacatgcaaagtgggggagcagagaccccgccccaccccgctgctctacaggatggtggctccagctgcatctgggctccgagggtccttaacagcgatgatgaagttgttggtccttcggctgccatggacccaggataagacatctactttctccacgtggtgacccctggcttccaggaactcaatctcttcctctgtgaactcacctgaaaaccatccccgacatatacacattcagaatgtacagagcactagttcaagagtcctacagtcagacctgagtcctcatcctggctgctccaccacagagctgtatgaccttggacaaatcactttaccttgctgagcctcagtttcctcatgcataaatagggattatatgagaacatgaagttgcagggactaaaggagataatgcacacacagcactgaaccttgcatacagtaagtgatcaataatatgcagtcattcttaatattgaaaacaggacaggccgggtgcagtggctcatgcctgtaatcccagcactttgggaggctaaggtgggaggatcacttgagcccaggagtttgagactagcttgggcaatatagggagaccccatctctacagaaaatttaaaaattagctgagcgtggtggtacatgcctgtagtcccagatactcaggaggctaaggtaggaggatcgcttgaccctgggaggcacaagttgcagtaaagtaagctgagattgcaccactgcactccagtctgggcaaaagagcaaaaccctgtctccaaaaaaagaaaagaaagaaaatggaaggaaggaagggagggagggagggaggcagaaaaaagaaaaaggggctttgtgggtcttcatctccacctgccaaagtcaagctgccatcattacttgccaggatttctgcataatccactaactggtctccctgcttccagccctcccttccttccttccttactggtctccctgcttccagccctccctccctccctcccttcctttctttctttctttcttttttttgaggcggagtctcactcttgttgcccaggctggagtgcaatggcacgattttggctcacctcaacctctgcctcccaggttcaagcgattctcctgcctcagcctccccagtagctgggataacaggcttgcgccaccacacccggctaattttctattttttttttttgtagaggtgggggtttatccatgttggtcaggctggtctcgaactcctgacctcaggtgatctgcccacctcagcctcccaaagtgctaggattacaggcgtgagccaccgcgcctggccccctgcctttcttatagcctgttcaaacagcagccaaggggatccttttaaaccattagtcagaccttgtcacctcccctgctcaaagccctccaacagcttcaacggaatttagaataaaatccaaagtccttaccaaggtgcctctaagcccaacattgcttgggaccttgctacttctctaaattcctcccctcatttccttctatttctcaccttgcttaactgtattccagccacattgacctccttgctgtccctttagaaggccaaacatgtttctacttcagtgcctttgcacttactgttctttctgcctggaatgctctcctagaaagtcacactgctggcccccttactgctatccagtctttggcacctcttcaagaatttcctccaccattacctaaaacagcagtccctaccatctttaccttgtttggttttcttccaaagtacttactgctacctgtatttgtttatttatttactgtgtctccctccactagattataagctttttgaagttaggaacgttgtcttgtttgctattgatctccagtgacagggtcagtacatagtaaatattgagcagatacttactacatagatgaacaaatccccatcccattggataagttcagaccctcatcatctcttgcctgggccatatcccagctgcttctcatatttccctgacttaaattctcctcccctcaatctacctcccctaaataagacaaatcaggtcatgtgtctccccttcccaactggataatcttaaggctgacctctgtgagaagccctgtaactccacatcctaccgcttctcaataaagatctagtcttcttctttccctaataggaagacttttggtagctcttgagatgaagacccaatcttgaatagcattaaatcacttaatcgaaaatctatttcctttgtggttcactttcaatccttttgattatggcaaggaacaagtttcagtctgctctctaacgcttcctaatctccttctttaatggagaaagcagtctcagagccttccatgggcaacaatatttaactaaaaactacacatatctatttgtatagctaacaaatagatgatagctatttgtcatctatttgtggcaaatgatgtcatttttccatttgtgattatgatataaggtctatttttaaaatacatttagggccgggcatggtggctcacgcctgtaaatccagcacttcgggaggccgaggcaggcggattacttgaggtcaggagtttgagactagcctggccagcatggtgaaaccctgtctctacaaaaatgcaaaaattagctgggtgtggtggcatgtgcacctgtattctcagctactcgggaggctgaggcacgagaatcacttgaacccaggaggtggaggttgaagtgagctgagatcgcaccactgcactccagcctgggtgacagagtgagactctatctcaaaaaaataataaaatacatttaggctaaaaaggaagttcatttagagagacatgttatgtacatattggtttagatggtgtgcaaatgtggcaaaagtcacaaaggtgctgggtaaattgagaactctaggaaacaacagctagcctcctggctgctctctgagccattcattctggtttttgcctaggctgttcctcctgtccagaatgtcctttacctccacataccaaattcctactcatacttcaaagccaagctacttgtcacctcctccataaagcctccccagggcctcaggtagatgaactttcccttcaccaagcccccactccttgtacctccatcttacactaaggccctgaaggcaggactgggctgagcccaaataacttagcacagagcctcacattcaacagagaccagcagatatttgttgaacaaaattcaatttcaaggatgtggccttgtcatctatcagctgggatccaagtgtcgctggccaaccacaggatgtgattgttgaagatcgcggtctctgcttctaatgtgattcagtccaggagatatcaagagctgtgcagtaaagaatagagtctttggtatcagccaggtgtgtgtcctaattgaagttctgccacttagtggttgatctttgactagtttataacttctgtgagcctcagtttcttcctctatagaatggggataataatattgaacaggcaaggactgtgtctcaatcaattctgtattcttttggactcgtgtcatattaatacattgtctgttataataaaaactcctcaaaggtgcagatactttcctgtttataaaattcagctgtgccaaaattaagcccttttcttagaggaaagtccgtctcctcaccctaaggtccacgatccggcgcctgcctgcctctctgatctaatttcatccttgcttaccttggtctcctttttagtcctcaaactcaccaaacccactcctgccctgagttctttgtacttgctcccctgacctacaaagctctgcaccaattctttgtatagtgggctctctcttactttttttttttttttttaggagataggatctcactctgttacccaggctgtagggcagtggcgtgatcttggctcactgtaacctctgcctccctggttcaagcaattctcctgcctcagcctcccgagtagctagaaccacaggcacgtgccatgcctggctaatttaaaaaaatttttttatagagacgggggggtggaggggggtctcactatgttactgaggctgctcttgaactcttggcctcaagcgatcctctcacctcagcctgggattataggtctgagccattgcacccagtttctttctcactctttagatctcagcttaaatgccaccaaagagaagtcttccttgatcattgagtccgtcctattatatcaccctgctttgacagttggcagagcatttatttgtctcatatttctttgatgacttattttcttgtttgcctgtaaatgcagaatccccagcacctaggatgatgcctggaacacgtacgtgttcaatacaaactgttgagtaaatgaaagtttgaagaatgaacaactgtgtcttattttacaaatgagaaaactgaggctcagagttgagacatggatttcccaaggccacacaaccaggaaatggcaagactggttccaatccccagatcgttcactgctccaatagaaatttgccaaataaaaccaaacttcactggcagttggtgctggttgaggcatgggcacccttgggaggagtcctttctctacctgtccctgtgcccgccccacgaggtctctgctctgcactcactgtccacctgcaggaggttggactgcaggtccgggtgtaggcggccgcgggccaggctgtcactcaggttccggttcaaggtcaggacattcagcagaacctgtggtagccaaggtacagaaaaatcagggctgtcccaggggtgatggtccaggattcctcagctctcacccttggtccaggctccttagtcttgagaattcttacaccgggtgtcatctgagcctcctaacagccctggaagacaggcaggcctgtgatgactgtttccatttcacagagagggaaagtgaagtccagcaaggaaaatgacttactccagagtttagaggaagccagggaagatacaccactagaaccaagtctctttaatctagcccggggctcccttcttttctctctggatagggcaaggttaatagctaggagtggtctagggcacaatgtgggtgcttttaacttagtggttaggagtgtgcgtaggctctggaaccaaactgcctccctgctctttctagctgaaggtacttgacctaaagtcttaacctctctgggcttcggtttccttatctataaaatagaaataaggattctctccagaactgggaaggttaaaatggttaacacacataacacagtgcccagcacttagtacgaactctttaaatgttagctattgttattatttccattttaaagatgaagagactgaggttcagagctgttaagtgaatgctccagcatcacacagttacaaattggtagcacttgggccggaacccaggagtgtctgattccagaacttaagatcgttaactcaccacctgccaaaataggtgcctggcatatatatcaggttctcaagacattcatggagccattctgaggtgttctggagaaaagcaggcccttcctttcaaatcccaccctaaagagggctggttgtctattcagatgctgggtagaggtataatgggacttgaggttaacagaacccaggccacccagatgctaaccccacttttcaatctactgaccctgccatttcccctgcaaccgggaaagacagggagcatcagggctccattttcactaagaaactcagcgcagcccatgtccacattgcccaggatgcgcctggcacaaaacagcctcagcccatgtttgccgcatgaggaatggaaacaagccacagatatgacaggcatctgcagtctaggccacagcttggctcccggctgaaaaaggccaaccatggcgtaaacctcacctgtgtcaggccgctgaggccccgcgcagctccattggcccccagagcgaggtaggttccacagagcccctccgcgggtcggaccactgtgggcagcaggaaagagagtggccgcttccctggctgcactgaattctcctgttgttagaggacagagaccacaaggggcaggtggggtgggacaagaccgggaaagggcccctccacaacccttccaactgctctccctcttctacatcttccacaggcccagttttcctgggagactggtcccttcccagacaacagtttgctatctgtgaaatgggtagggtgcctggatgggtggggtggatgggggagtgataagtacatccactgagctatgaggctgctacgggtcacaggagaaaggaccaagccaagaaagatggcaatggggaagaacaggataaccccaccctgatcatctctatgtgtctttgccctgctggggccccagatggcggggtgtaagagtgctgatttttaactagataaaaattattaaatccttcctccttgggtccctctttggtgcccaaccatagggctgagccccatcagctcaagctcacatagtcacagaccgctagtgctggaaaatgcccaaaacatcaaataggagccaaaaccctcattgtacaggtgaagaaattgcccagagagggcaagatcttcacaaggtcacacagtaagacagtgacagaatgggacaagggttcttcagacccaccaggctccatgtcccagacttagcagggctagggatgaggtgaacctcttctttaggcttccttatactagaagattctggagaaagtagggagaaaggggcagccatgccattgcacctcctacctataggcctcagggtccccaggaaagcagggaagcaaatcctaccaggctgggtgcagagtggttagctgtccggttgggccaggagaagtccagcatctggctgttgagcaggatccccgagggggtgataaggccgctgccaaagggctggttcagggagctgggggccgaggtggggttgggtgagccctggcccatcctcacctctacccagcccccaccccctcttggttcagaggatcccttgttccaggttctgagtctgagctggcatacctaaccatggccacaatgaagtcatcaggtcccatgatcagcacctgggcagccgtgggagctccgtctagttcatagacaggcaggagtggggcaggggctgcctgggagtcattgatatggccccggaggtaggcggcctccaccttgctgaaaagacaaggggtgggagatgagcaaacaacaggctctcaatacaccccacctacctcacttttgtggtgtttgtgtaattatttgatgaaatctacctccctcactggactactaggtctatgagtgcagaagctcattaattgcacataagaaatacccagaaaatagctgttgaatgtatttaggtattatttagattcttttctggaaccaacttttatttaatgtttaaatcaagagccttttagttatctgacttcttaatcctttctatgaaagtgcctggtgcataatggatcagaaaatatttgctttgaattaacaaactggattcatttaaactaatgtttgtagtctaaagttttattaagagtttagttgggggaggattttgtatatgaggattttttttttcttcctaatgagatagagtttttctctgtcacacaggctggagtgcagtgacgctgtctcagctcactgcaacctctgcctcccaggttcaagtgattctcctgcctcagcctcccgattatctgggattacaggcacctgccaccacacctagctaattttttttagtagagacggggtttcaccatgttggccaggccggtcttgaactcctgacctcaaatgatccactcacctcggcctcccaaagtgctgggattacaggcatgagccaccacatccagtcaggatctttactttcttttagagttttttcccaaggcacagagtaagtgctcaataactatttactggatgaactggttgaatagatttcatataggtgtgtgtgtgtgtgtgtgtgtgtgtgtgtgtgtgtgtgtgttttagagcaaagtttgcattgaccttagaaacaatatgtaatgctccagacttttaaaaattcaactgaggcgggaggctgaagcaggagaattgcttgaacctgggaggcagaggttacagtgagccaagatcatgacactgcactccagcctgggcgacagagcgagactccatctcaaaaaaaaaaaaaaaaaattcaactgagggtttcttacctaataactatgtgttggattatccatagctgattagagaataagttaccaaagattacttgaagacatttattcaattttcaaccaaacaaagctttacatgtatgattttgtttagtccttaccacaaccttacaaggttgataccattattgtcaagcccccttgtagaaacagatttagagagtttaaaccacttgcccaaggctgcacagctagcgaagggtcaagctggaatttgaatgaaggcagtctcaccagagcccacaagctactactatgttatgttgctaatgaagctgtattaccaccaccttcagtatttgcttggagactgtttgtttgtttgtttttggagacaaagtctcactctgtcacccaggctggagtgcagtggcatgatctcggctcactgcaacctctgcttcccgggttcaagtgattctcctgcctcagcctcctgactagctgggactacaggcacgcgccaccacgcccggctaatttttgtatttttagtagaggcagggtttcactatgttggtcaggctggtctcaaactcttgacctcaggtgatccacccgccttggcctcccaaagtactgggattacaggcgtgagccaccgtgcctggcttttgtttggtattgagctttcttttcctactcaaaaggaggagcagatgggcttatataggtgctatgctagcctcaaaaaaatttaagagccacatgaagtaagccaactcattgtgctgataggaaaggtgaggtgcagggagaggcacccagtgtcacgttgtgagttggggttgagctgaaattgacttaggatttcaggcctttattgctataccagctgcttttctcctgaccctttccccacacccaccgctgcctctgtagcccccaggtcctgcccaagacccacctgagcatgtcatccatgctctcagtgatggtagaatcatagacgggatctcccagtctgctggccagggctaatgcaatcttcagggtctgaaaatacagcagggatatggaagaggctgccaggcccctcccagaacccacacccagtggactttcgtgtgtgagaaaacttggaggggatttagtcctgccctatggcagtacccaatctccccactcctaatatccttaaatccagggaaaggcagacgggtcagccttacctctgccacccagtgaagagcctgttctcgggataccaggctggtgagattgaagccctccaggatgttgagagcactgatgagggcagggcccgtgtgcggaggtgggggactaagaaccaggtggcctgaaaggacaggaagtgactgatggcagggtaggggtcaaggcaccttcacatcccacatcccatctccacattccaccatcacacactgagaccactgcgctgaactccctcaccagatggggaaactgaaacattgagaggcaaagagactcattcaagttcacatggcaagtcaagggcagggccaggacttgaactcagaacactggtcttcagtttcctctgccatttgagaaaactaaggctcaagagggctgtggcttgcccagagtcacactgcaggctatcagcagagcacagcagaaacaggtgaccagatgttcatattcctggcctgtcatgtgtctccttttagctctcccataggccaggatattatccatgactcctgatggtctcatccagccccaaacttcttggcagcagcaaccttctcttcctattctgttactagatgtttggacatcaaaggaataatagctgatgcataacactaacattaactcatttagtcctcactgtggctactgttatcacacatatttgataggtccagaaactgtggtacagagagacaaggggaatccagagcactcaaggtactagcattgttgagacaacccaggctgggaaggggaaatggaaaatctatattcagtgcatgctctgatcagggcaacttcctacatcatctcatcaaatccttatgggcatcctaagatgtaggcactattattatttccattttaaggagggaaccaaggctcagagtgggaagtagcttgttcaaggtaaatggcacagttggtactcaaacccaggtcttcctagctccaacgctacgcttgttcttttttcttttctgtgtgtgtgtgtgtgtgtgtgtgtgataatggtctcactctgtcacccaggctgtagtgcagtggcacaatcatgcttactgcagccttgacctcccaggctcaagcaatcctcccatctcaacctcctgagtagctaggactataggtacaccaccacgcctgggtaatttttaaattttttatagagacggtgtctcactatgttgcccaggctggtcatgaactcctgggctcaagtgatcctcctgcctcagcctcccaatgtgctggggttataggcctgagccactgcacccagctgataggctctttccattgcttcatattccactgcctctggcagaggaatcaggttggagattgaggcctggaaagttgaactcagagaaaccctttcctggggcttgatgtgatctggctctcctagaagggaaagaacctgagaatcttctgagaaatccagcacctaccaccttgggttcagtaaacatggaccccacccatgtcataagcttggttttctgggttccctgttggttttcttgagtttggccagttgttatattccctcctcgggcctcaatttctttttggcactatgaggagctgggtctatgactgtcttgaaaggttcattctactgtgaagcttggatggactttgtcttaaaaattcttaggaagtacagggcagtgacagcgctgctggggaaagggcagaggcaacacagagcccaaatcaagaaaacctatggccagaaccccaacttccaggttggaccctttgaccaggtccaccccccaatatcctaaatacttggggtaactgaccccacagctacttttcagaaggtgggctgactctggtttgcttcaacagttgactgcccaggtagctcactgccttagtttctctcctgtgaaatggagaggagtctctaggccaaaacgatgtggccatggactgggaggcttctcctgaggggggaccctgggagccgggggagaggtcacctctgtacacgccacacacaggcttctccacaagggcgctgtaattgctgaagtcctcttcggttatgacaccccctgcgtgctgagcctggagggaagagaatgagggaatgacctcccaccactgtgacatggtggttttggcctataacacgtttggatcacagacagatcagctgtttataacttctgtgccttctgcaacccccatcgtggcctttagagaccccattatccctagacacctcaggaaaaaggaagggggaaaagcactaacattgagcacctatcatgtgccaggcatcacactgggtacattccatgaatgacctccttagcttgccattcaagactttttgtgatctggccccagcctacccctcccacctcatgtcctgctgttccccagtgagctctatgcagctgcagagtgacctgcagttcctgaactcatgccttcgtgtctttgtacctgctgctctctctgcctatgtaaaaggaaggttttctacttatggcacacttgcctaggagataccaaaactgaatgctgcatctcaccacaaccaactaaagccactagaaaaccatgactttgagtgatcctagaaggactgacccttattggacataaccaagccctcattattgaccaatgaaccaatcttgtacaaaccaatgggctcattccatcctatccagtgtgctgtcaaccctaaattagcataaccactctgaatcctttccttttttgtaccttatagtacttgaaacccttgagttatctatcttcagagaattacacattgattttttttttttttttttttgaggcagggtctcattctgtcgcccaggctggaatgcagtggcacgatcatggctcactgtagcctcaaccttcccaggctcagatgatcctcctgcctcagcctcctgagtagctgggactacaggcacatgccaccacacctggctaatgtttgtatgttttgtagagatggggtctcactatgttgcccaggctggtctcaaactcctgagctcaagtgatccacccatcttggcctcccaaagtggggattacaggcatgagccaccatggcctggcccatttgaattcttgagttcctttttctggcaagttaataaactcaactttgggtttctttttatcaaagatctgatggtctttgttacaatctcctgcattccctttgccacctccaggaaagggcacacaacccaggcctggccaattggggcattcccttctgtgccacagtgattgatttgggaatagtcatgaaacctatgatgagctaataagacacaacctggaggcttttgctggaactactgggaaggaaaaatgctctttctctgggatagcttgctggaaggatggcctgatatgggctggtggggagcaggtggaaaggatctgagagtgaatccaaacaaaggaaagtagagttgagagagagagaaagagaaagagggagagcaaatcctaacacagtggattgataatctggacacagaagaatctaaagccagtaatctcctggactttccagttaagtctgtttgagtctatcgccacatccagtgcccagcatagggcttggcacagagcaggcactctgtgaatgttgaatgaataacagacctatttaattcccacaactgtatggcagagacagatataatcatccccattgctcagatgagagaaccactgagttggtctatgcatccttaccatgaacttaattttccattaggacttttgcactattaatgacagttctcacatctgttactgcctgagactgggactctttgggattggatggtaaacttctgtgtcaatctccccagtcttgatactcaacaatgaaagaggtgcttccctcagtccctagaaaacccaaaagcagggaaggattgtgagcttagggaagctgaggccgatactgggtctccaccaggcctgggagggacatgacaagcccctgcacaggctggcatcacccctgagaagcccaaaggtacctctgaatcaagacagaacacttctggctaggcatgggggctcacacctgtaatcccagcactttgggaggccaggacaggtggatctcttgaggtcaggagttcgagaccagcctggccaacatggtgaaacctcatctctactaaaaatacaaaattagctgggtgtggtggtgcacacctgtaatcccagttactcgggaggctgaggcaggagactcacttgaacctgggaggcggaggttgcagtgagccaagatcgcaccactgcactccagccagggtgacacagcaggactccgtctcataaaaaaaaaaaaaagacaacacttccatcatcccaggaggtttttcatgtcatatcccagtcagctcctcccagccccaccaaccactgatctgatttctgtcactagaggttagttttgactattctagaatttcaaatgaacataatccacagtaaataatatagaaagaaagggagggagggagggaaggaaggaaaaaatgcggacgcggatgtcctgcaatagggaccttggggcatgcccccacccgcacaacacgagcacttacctcggccaccatctccagtgtgaggttgccacctgcgtagaaggcagccgggccggaggtgccaagtacatccagcacctcagccaggtcgggccgatgcagcaacgagccaggtagtggcgggcggcccgatggcaggaacgtctcccggaagcgctcggacatgttgggtggcagctgttcagccagggcacgggctaggggcagggacgggaggctgggcagggcgggacgccaggactggaccggatgagacgcgcaatagatggggtagatgggggctgagtggcccaccctaagtgccctgacccccaggagcctgttaagtgcgaggcagggatgtctaagggcccttcccagaccccctcgtttgaggccgcctccaggtgagggtgggataaggtggggagggggtctgaggagcaaactggaagagagggcctctctggcttgggctccaaatctcaaagattctacccttctccatcaacctcatgtctctcccaaatccccaggccccactgacctagatcatgagtcacgttgaagccatcttgggccacagctgctgcaaaggccaggacttgggaccatggcagcctgggggggccggagagcagggggtggaggaggtcctgggggaatgaggaggggtccggggggaggggggttcctgggaaggagagtcctggcaagggaaggggatattaggagggggagttgggaaaggaagaatccagggaagtaggagaaggccacccaaggagagatgcaaacgggggtccctggtccccagggggagggttgttacctgccatagagctggtgagcttcatgtagccccttcaccattccgggaacccccaccaagagcccaggctgggcaaggcgggtaggcgagggagagaggagaccaggtcactggaaggggggtgctgggctgaactccgcagagccccaagccagggatggctggcacaggggagagacacaggccaagtatcccaggggagggacaagctttcccaagcaggcacccctcccatctccctgacttcctatcagcaaatgcagaaaggcctcttttagctgccgtagttgggggatttataaattaagcaaaactcttttaagagccaggacataaccagtgtagaaagacacctgtctacattggatttcaccaacccctgcctttttttttttttttttttttttttcctgttacccaggctggagtacagtggcatagtcatagctcactgtggcctccaactcctgggctcaagtcaagcgatccttggtgcatgctactgtgcctggctaatttcaaagcattttttgtagagacaaagtctcactatgtcactcaggctggtctcaaactcctggcctcaagcaatcctcctgccttggcttcccagagtgttgggattacaggtgtgagccactgtgcccaggcaaccctaccttttaaaacggtggacaaaggaccttcatttaacctattcagtttcaccccaccattactctgagctctgaagactcaggggtgtgtttggcttttgccaccgcactaagtacccatttttccaagttattcgatatcttctttttctttcagcagacagttggtttacttctggcaattcccctctaatcttccaatatatcaagggctgggaaagttatagtcaactggctcagagtgagatgtgtgagtttcattgcatcaacttcgtgacatttcagggtactcagtagccttttttcttccttcccacgtgccagataggtaagattcccagagaagtaaggttccagattttctagttcattattttatcttgggggctgcctgactctctcatagcctaagagaatcctgctcaactctttttcccactcccctggtaaatacttagcaaattaatgcttgggttagcagaagggcaatgaagagagactcccctgaactctctcttctcaccagggtccccaccttggtctcccaggatctttgcagggtctcttccctgagggcccctggtgcggactcccggaaatcaattaggtggctctcatttcgtcggatgtcatgtaccagcatcacgcccccactgggagagacacagaaggggaagtgtgatgataacatgctacccctctgtacaatgaatctgctgcccctccacccccagtggtgagagctgtaggctcagtttttcatttggggtcaggtgtctgagctccctccccagcatggattcacagactcagccaccctaagaggatgggagcaaaaccaagagggttggagacccagggtccatggacctcttctatcctgtcactggagactttaatccctgattaggaaaagcccagagactggcagaacaggatgttctgccccatgcccccaccctggaccagagctggacccctgccagcttcctgcacctgtctacttggtatgtcccttgcccctcccccaggactggattatgtaaggatagaacatgcaaaaccaaaagaggaatttctttggtacggcttggagagctggtcttacaggagccaagataggaactttgtcagcttgttccttttctgtagcttatttacgtctaagatgggggctgcaaacttaaatgcccacagccaaatgacaaactaaggcaagcaggacagagaagaggaagtggtagaaactacggcaaactggacagtgcatgcccatcatgggaagcagcttctattccacgccaggtaacttcagccatgtgagaatgcgggcccaagttgttatcggatttcccgattgttcaagagatgttggaaatctggatttttatgaaaattctcaactttttaacaaaagcaaacaaaattttaagacagttcagtgtctaaaccaaaccagtctgtgtgctgggtgttgcccatgggtggccagcttgtaacttctaagagttcttagtgcagggtgtatttttggaggacagagggtgcaaggcttttcatcagacccatagggatttatgatcctagaagttgaaatatctctgccttaattgatgacagtatacctccacctgtgcatcttaatttatggtttacaaatttctttttctagttaaaaaaaaaaaaaaaaagcttctgaaaacactttcaggttttccataaggtagctttgctcttctgactccatccagggagaagggggtgaaatttggtgtagaaagagaaaatgcaaggagttggggcccaaaagcccctctccctaagttaggagtgctgcacatgaggcctacagacctggaggcaagaagtaggcctgggggaccccgacctccactgctccttacccgcccaggccagaactgtgtggagccacgatacccaaacacaaggctgctgccaccgctgcgtccacagaagatccctgtttactgagcacctcgatgcccagtgaagtgcagcgggcagcatcggtcaccacggcaccctgctggaagatctgggaggggaaagaggacttggtgggggcaggaggagctgtccacctccctagggcacctccactagccctagaactctacgcggcatgaaggtcgaagccctgcccccttgttgccttgactctgccctcattaccccaagtgcctcctaatggatctgtccttattcttccttgttctgtctccctcatgccctggagctcctctctttgggaccttcctctcccaagtcaccaccctctctccccttctaccactcagccattccccagtttccacagttcctcaaacattaccccactccccactccccagtttcctccccctccccatttgtccccctcacctgggggtccccgaagtagatctgcatgaccagcgccacggtgacaccggtagcgaaggtgagacaggccgtgacgatgaccgtgagcccatcctggcggcaggagcactcggccgctgcggcggagaacgggtctttgcgcgtctcgcgtagcggcgacccgtcttggctgcccatctccgacgacgacgatggcagccgctgcagccgtgcagacttcaggaaggagtccgggtctgcgggcaggcagccggggtcggtctgggcatctcctatctggccctgcccaccctccaggtgggactattcagcgctttccctgccccgcccctgccacacaatccccgcactggctagcactactcacctttcctcattttcgcgtgcaccccaggacaggcggggcaacggtgcccggctaggaagagacagggacctccccagctgggcagcagggaggctggattcccgcccctccctgatacctaggccaaatttcctggcacccagggcccagggctgagaacacttcctggggggtggggtgggggttccagccctcagtggaaatcggatcctgccccagttggggcccagccttccatgcaaggaggcagctacataaacagagtggagggaccctgccttccaacctcacttcagttatcagctcactcattccttaaatatggagagccctatgctaggtgccaggggacgggaacagatagttcctgccctcatgtggttcatagagccctggaagaaaaagccaataagcaaaggagtctataattacaagttgtggcaggtgctatgaagaaaaaggaggaaatgacagaataatggtggtaggggagggaggattccttagctgcagaaatcagggaaggcctctcaggaagtgacttttaagctgaaaactaagggatgagaaggagccagctataatgtagagcaaagagtatgtgtgtggaatgttctggaaagagggaacagtggatgcaaaggccctaaagtgggaatgagcttggcacattagaaaaaaaaataaccaaggcctgggcggctctggtgtagcaggcatggggaaagagtagtaagggtggaagctaggccagatacatactgagcgcagtggctcaatcttgtaatcccagcactctggggggccgaggcgggtggatcacttgaggtcaggagtttgagaccagcctggccaacatggtgaaaccccggctccactaaaaatacaaaaattagctgggcatggtgatgtgtgcctctaattccagctacttgggaggctgaggcatgacagtcacttgaacccacaaggtggaggttgcagtgagccgagatcgcgccacagcactccagcctgggtgacagagtgagactctgtctcaaaagaaaaaaaaaaaaaaaggaagatatgtggggctctactagcctggggagaagcttgggttttaccctaaggactatgggaggtcactactcgagaggctatttttgtttgtttttgagatggagtttcgctcttgttgcccaggctggagtgcaatggcacaatcctggctcactgcaccctccgcttcctgggttcaagcgactctcttgcctcagcctctccagtagctgtgattacaggcacatgccaccatgcctgagtaattttgtatttttagtagaaacagggtttcagcatattggccaggctggtctcgaactcctgaccccaggtgatctacctgcctcagcctcccaaagtgctgggattacaggtgtgagccaccgcacccagcccactactagagagttttaagcaagaatgtgaaaccatctgttctgtgtgttattgttgttgtttgagacagggtctggctctgtcaccccagctggagtgcagtggcaccatctcagctcactgaaacctctgcctccctgcaacctctgcctcccaggctcaagccatcctcccacctcagctcagcttcctgagtagttgagactacaggcatgccccactacacctggctaatttttgtattttttgtagagatgggatttcgccatgttgcccaggctggtctcaaactcctgacctcaagtgatccactcacctcagcctcccaaagcgctgggattacaggcatgagccactgcgcccggcctgttttgtgttttaaaatgatccctctggctactgtctggagacaaactggaggacgataagagtggaggtaggagagaactgaaagctcactatttgctggtggctatggacaagtcagtcaagtcatgcacctcaccttcctcattctagtaatggaactaatccctaactggtgggataggggtacaaggattccatgaggtgatgtgcacccagtgcactgtaggtactcactccaagttatttctattccttttccaccttgaccagggctgagaccctcttccatcccatagctccctcctctgagtgttattagctgtgaacccaggtccctaaatggcctaaaggtcctaggtgtttgtgaacagtaaagaaatagtctttactttaccttgacctcatgctgtactcacaatatgttttttaaagtttattcattcaatttttttagtacctgctactatgcactaggactataacccctttaaaagtctatgtgataatattaaaaactgaccattttattgttctgtttaaaatacgtggttcactgatgccaacataataaacatctaagctccttgtggtgtttaaagaccttcatgatccacagtcccatcttttgtgtaaataagaaaccaaatatatagataaaatgatgatatatgcaagaaatgtttataaattattacagaagttactcttgggaaaggatactgaagatgggaatgagatggggtgggagtttttttggtttgaaatttttaccacttatatctatttcctttttagaaatcaatacataaaccgggagtgctcgtgcatgcctgtaagcccagctattcagaaggctgaggcaggagatcacttgagtctagaagttcaaagctgcagtatgattgcaatatgaatagccactgcactccaggctgggcaacatagatagaccctgtctctaaaaaaaattaacacatatattttgaaatgaaaaggaaaaattacagggagataggaatgggaaaggggacttttttattcttcctcactattgctttttttttttttatcatgaacatgtaatttttgtttttgtttttgtttttgagacagagtctcactctgtcgcccaggctggagtgcagtggcgcaatctcggctcactgcaacctccatctcccaggttcaagtgattctcctgcctcagtctcctgagtagctgggattacaggcacatgccaccacgcctagctaattttttatatttttagtagaggcagggtctcaccatgttggccagtctggtcttgaactcctgacctcaggtgatctgcctgcctcagcctcccaaagtgttgggattacaggcataagccaccgcaccctgctgtttttaaactttattttcaaaaaaaggttatcttctgagactctccctcacttcataatgcttgcctctaaccctcaacatcagcatcacagagtctgtaaataaaactggaattcatccaaacaaacagacgttaaacacccactgtaggcacagaactctccttggcccctagaaatgtcttgttgttgttgttgttgttgttgctgttgctgttgttgttaatagagacaaggtcttgctatgttccccaggctgttctcaaactcctgagctcaaacaatcatcccgcctcagcctcccaaagtgttgggattacaggcgtgagccacagcacccggcattagaagtttcaaaagaagtgtgggaaagggttttgaacttatatttattgatgctgactacatattaagcattttacatatattcctttattgaagtgttcccaagactttatgaaataagtcccactctcgccactttacagatgagaaaactaagaccaagaaaggtgatattgcccatctcaggtcataaaatgagtaagtgggccaggtttggtggctcacgtctgtaatctcagcactttgggaggccgaggtgggaggattgtttgagcccaggtattcaagaccagcctgggcaacatagcaagactcctgtctctacaaaaaaatttttttaattagccaggaatggtggtgtgcacctgttgtcccaactactcgaaaggctgaggtaagagcatcacttcagcctggtagttcgaggctgcagtgagccactgcccaccagcctgggcgacagggtgaaaccctatctcaaaaaatttaaagtaaaatataaaataaaataaaatgaataagtggcaggaccaagagtctgtgtaactagaaagcctccttcccattgctccacatggcatcaagagccatttctaccctcagaaaccaaccttacaagctaatttttgttgctatttcttggtacttattgctttgtttttgagagataatcttcctgccaggctggaatgcagtggcgcaatctcggctcactgcaacctccgcctttgggttcaagcatttctcatgcctcagcctcccaagaagctggaattataggcatgcaccaccatgcccagctaatttttgtatttttagtagagatggggcttcaccatgttggccatgaggctggtctcaaactcctggcctcaagcaatccgcccgccttggcctcccaaagtgttggcattacaggcgtgagccactgtgcccggccctaggtatggtttaatttgttttctccagtcagatataaggatccaggaggtaaaggtgacatgtccctatcatagctattcaagactctctactccaccagtccatcataaagttattgatttatacaataaaaatatttactgagtacctactatgtgcactgtggaacagctagggcaataacagtgttgattttactgatagggaagagcaacagcaggatactggaaaaagattaatttgcaaccagaaggaataagtcttttgggagaaagatgacaagttcaattttggttattataaatttgtgggacaccataagaagctgtctggaggcagttggcctagtagatatctaatttttaccttcagggctcatccctggtatctgcttggataccacttctcattcaattttcttttaaggaacattctctctcctctctcagccaactccctcatccctgaccaaagtatataactcagacttggccagtcagaacaggtacctctgtgcagtaacaggcaatgtgaacaaagccaggccaataagacccaaactttgttattttgctggaactactgggaaagagaaaggctcctctttctattacacttaagttgctaagttggtaggatgtaagcctgtagctgctgggggcatcttgcccctaataaaatgggaggccttctgccaatgaagcccaccaaaagaaggcagagcaaaagatggagaaaagtccattcctttttaggtaccttaatccagctatgcctgaaaccccatatccctggacttttcagttatgctacccagtaaaattctctttttggatgtagctcagttaaactgggtttataacaaaataatcctgaacaaaattgattatacaagtccagagtttaggagagtgatcttggctagaggctagggtcatccctggcttgttgtttattcccttaaggggagaatcactaaaataaataaataaataaatatatatatatataaaattttgaaacagtgtctcactctgttgcccaggctggagtacagtggtataatctcagctcactgcagcctcaaccttcagggctcaagccatctgcccacctcagcctcccgagtagctgggactacagacaggcatgcaccaccacacctggctaatttttgtattttttctagagacagggtttcaccatgttgccccggctggttctgaattcctgagctcaagcaatctgcccaccttagcctcccaaaatgctgggattacaggtgtatgccactatgcccggcagaatcaccaaagatgtctgaaccagggagtgacatgaccagaagcgatggatggattggggtggggactgggcaagagggaggaggcaggaggagtagctagaagcctataaataatattgataagagaggttggtggcttagtctacagtggtgatgacagggatgatgagtaggaatttggaagatacttaggaggggtgcagagagcacttgatcaccatttggaaatgagaagaaaaggaggagtccagcatgccattcattattgggagactgggtgactggcagtgtcattaatggagaatggcagtggaggaagagcaggtgcatggggaagggatatgatgagttcaaaatagaacatgctatagatgaggcacttgcaggacatctggagacacaggcctgggagagaaaggaacacaagggcttggagctcagaagaaagaaagtatttcccaaccttggaatgatcactgtctagctctctttcccacagagcctgatgtggggtgcctggcacttgggtttagggaatggcaggctagaggctagctgggcacaaccaaggtcctggctaagaggatggtgctgtgccactagatggtaccaccaggttgagaacacaggaggccatgtcagcctgtagtctggtccaggtgaaccgaggaagccttggggcttggaagtaggattgggagatatggcattcaaatgattacactgaaatgatggcaacacacaaacctgacacataaatttggcataaggtataaactcccagaagctcagatgactaggatctctgctggatttccatacaggggtgagggcagagcctgtattgaacttcccaaaatactccctgaggttttggaacttgctctctcctaccattctttcatcctctctcctaccattctttcatcctgagatcttctctctcatgcatttattcattcaacaattattgagtgcccaataaataaatagagatgagggttttttttgttgttgttgtttgtttgtttttttgagacagagtctcactctgttgcccaggctggagtgcaatggcgcgatcttcgctcactgcaacctctgcctcagcctcctgagtagctggggttacagacacctgccaccaggcctggctaattttttttttttgtatttttagtagagatggggttttgtcatgttggccaggctgtttttgaactcctgacctcaggtgatccacccgcctcagcatcccaaagtgctgggattacaggtgtgagccaccacaccggccagtgtattttgttttgttttttgttttttgtttctttttgagactgagtctcactctgtcacccaggctggagtgcagtggagtgatctcggctcactgtaacctctgcctccccagttcgagtgattctcctgcctcagcctcccgagtagctaggattacaggcacccaccaccatgcccagctaatttttgtatttttagtagagatggggtttcaccatgttggccaggcaggtcttgaactcctgacctcaagtgatccacccacctcaggcatgagccaccgcgcccggcctatggataaggtcttgatgctggagaaaggagagtgaacaaaacaatcatgatccctgccctcatggggcttacagacagggagtaatcagataattgcacaaataaataatcatagattttggtaaatgctaagacatttacagagggccagaagaaaacatgtcaggcagttccaatctctaggtcaagagagacaggcattctctgttgagctggaagaggaaactaaggcccaggacagggtaggtgtgcctgttgtcgcttggtgagtcagggctgtattaggaccagaagtctcactcctgactactgaataaaaggcctagcttcaggctgatatccatcatgacacatcttcccactcctctccctgctacctcctgattccactccctttggaaaataagttttgatccgcagccctgacatttgacgcccataaacctctaaactccatcttcattatctcctcacccccaccccatacagagtgcagtccagtcaggttggcaagggctgctggtcagggccagatgaccagaaagtgtagaggaggagagaatttggggctttcaggctgggagcagctagggaagggccaagccggaaaagcagcatctgccaggctggtaagagacaaggctcaagtgcaggcactgcgaggaagcgagagtgaggtagaaggatgctctaatgccaggaagtgacgtgcagggacagagggatgggggatgaaggatgaagaatggaggggaggatgaagctgggccacatggctaggaggaagagcagcagggaaggaatgcacagagagctctttgcccccaggtctcttccaatccctgtctcctccttctcttacccccacttctcacaattccagcagagggctgaggggaacacagtaaaattctggagactgcttcctagggagcagagtaccttactaataccccggccagatccatggctcagggaggggtggggtaatccacaggagagtgaaggcgttctagtccccaaggacttttgagaggtcatgcagtccatgcctccgtctcccaacacccaacagaggggaatcatattctctttacccctccctagacatgaagagattctccgcttctcccagaccctctgcttctcacaatccctggctgtggggaacttctcttaaggcacagattggatccctcttgctgcagtctctgacttggtttctcctatcctgtcctctgtggctagagaaagccctcttctgggtgatcacagcggttccttaggatctccccttcaacattccttcatcgttagttggttcttcccagaaggtaagcccaatcccttctactgcagtccctagcatcctctccgttgtcgcatcctacgcctccaaggcagaaatgcacccccttcctcaccaaataattaacagagacaagggagaagaagggagagatccaagaagatggggatgaattaaggagatggagctggaggtggatgcttgacacagaagaaggaagaccggggacttcccaaggcagggcagggacggggtcagcgggcctcaccggtgtcggggtctcccagaaaggcgtcctcgtccttgcggcccctcagcggggccgcgggcgccggctcgtcctcgggcagccgcgggaagctggtgatgctcatgtagtccactggcgagtaggcgcccagggcgctctcctggctggcctcgttctccgccgccatcctcgcccgcgccccccagcagcgcagcgcctgccggaagtggctgcggcgggggagtgggagggcggagggcggggcctgatcttcgcgacagccgggagggggcgcctctcccagccctcggccgtgtcccggtctgactcgcccccgtctgctcagcgctatcagcctgcagctggcacacaggtgcgtgtagatggacagccaggaaggcagcgcagggtcgaggggagagcgcggggcaagcgagacttcagtggctctgcactttacgcagctcagggaccaaaccccttcctccttccagcctgaatacagctagtgtcctcctcaaatcccaggcttccttttcgggccccagaccctttcactgaccgcaaatccctctcgaccccagatcctgtctctgaccccaaactcctcggaccccagacccctccttgaattccgagatcctcctcctccgattttagactcctcctccgaccttagacctctttttcgacttcagactctgtcttcacccccaaacccttttgaaaaccccagcccatgcttcatctccaggcctctttgactgcagacgcctctttggacaacagatccctcctctgacctcagatcccttcccgcaccccgacacttctgactcctctttcaaccgcattctcaaactttagtgtgtgttaggatctttgaaagcggatccccagattccactccagagatcatgattcagtaggctgggatgaggtccttggaacctgaatatttaccatcattttaagagtttttgatgtggttctggaaaggacactttgagaaagaaggagtggtggtagtgatggtagggcaggagtggggcaaggtggggaataggtctccatattctggatgtctgggttctattctgccaccgctcaaacactgtgtaatcttgggcaagacaattagtctctctatcagtttccccatctgtgaaatggaaagaataatagtacccattttagagggttgtcatgaggattaagtaacagaatggaaagcgattagtatagggcttggcacctactcaataaatggcatcatcatcatcatcatcattgccttaatctggtagattcattccctccaaactcatccatcctctctccactccaaaattccaaccacactacagcttgtactacttctccatatccaaggatgagggaggttccttcttttacgaggtctctgttccaaactttcattgtgaagtccacaggaagagaggggggctggtgaagcctctatacacacatcctttctcttcccaaccccagaccagtctcagggatggcctgaagtgcttgaaaaatctactatatacacagcagctgcagtagcaactatagacaggagggggaagcagtgtgtcgggaacagctctggggtttgggtgtaggacttgggagagaggataggaaggagagggctactcagagctgtgtggtaagagtgcccagggagggtaacagtctatcaccaaaaagtgtacccattgtctgtgcctttccccaccccagagagttcttatctcctcagtgatgtttgtagggtctattacactaccctgaggtctaatccctctggtgggacccttccccacttgatgaggtctgcaccttctcagtgatgtccactcccacagtgtagttggcagctcctcactggagtttgagtcctctggtagggtccacgtctccttagtaaagtctatatcctctgtatctcttaggggaaatccatgtctcctcactagggtaagtgcccttcaaagccattcatgtcctattagcagggcccagggcccttcagtcagatctgagaacccccagcaacatctgtgctcccttagtggagtccatgtactgtcagtgaagtgtgtgtcccttcggtgcagtgaatatctcctttatgaaagtatctgaccccttggtggggtctatgtccaccccaagaggtctgtactccttcagtgggccctcagattcccgccctccttgggattgggcagactctcggtctcccatagagagattttttttcagcttagggtgtgcaaggtttacagtcagctgggcaaagtgcagggaagtagctgggaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtggtgagtgcaggtgagagatggaggagggtcctgcctgacttctttctggggtggaggggctagagagaagctagaggtaattaagcccaggttgtggtggtggtggtgggggtttcccttggtggagtaaagagattgtgaaggaaagaagagaatgtgggccaggtgtggtggctcacgcctgtaatcctagcactttgggagcccaaggcgggcagatcacctgaggtcaggagttcaagaccagcctggacaacatggtgaaatcccatctctactaaaaatacaaaaattagctgggtgtggtggtgtgcacctgtaattccagctactcgggaggctgaggcaggagaattgcttgaatccaggaggcagaggttgcagtcagccgagattgtgccattgcactccagcctgggcgacagagcgagagactccatctcaaaacaaaaacaacaacaaaaaaagagaatgtgaatgatttttcctatttgcacagactttgatattttacaagccttagcttcaagcctgacgaggaagtaaaaccaaatctggagtcaaagaacctagctttggccctaacttggtcgttatttgctctctgactgtgcaccagttccttccctttcctgggtttgccatttgtgcaattaggaggtgggcttattacaaaaaacctgaaggtgtctcctagtcttcacttattgagtcttgtactttagatctggatggagatttgtgaaggcaaggagattgaagacatgtcctcataagagggagaaaatctgagctggttccagggtgagcagagaggaggtgctgtcgccagagcatgccctcaaggtcatgggagaagtttttccggaggacgagaatgtgggtgtggctcagagaggggggacctggagggaagggtgtcacctggaaggaactggtgatagtcaggactgtgcaatcagatcacggggcggctccgcgatggaccttactcaactcctctccttagtccatccctttccctttcgatccttgccttaacccaaccccttatctgtcactccaagaccccaccccactctggtcactccatggctctgcctcctctcctgtcacaaccagccgggttactccccatcactccatgggcccacctcctctcctgtcccgcctggccccgcccctcccttggcactccacggttccaccctctcccttgtcacacccggccccgccccttctgctttcactcgacggcgtcactccttccggcaagtcagctccacccctatccctcgacttttccttatagtatttctgtccttgccaacctcgatccctccccaaccagacacggccccgccccctctggcaccgcccacccgccagactaagccactcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcggggtgaggcccggcccgggcgggcctggggtgtcagtgaggagaagagtgggggctccctgggggagtcgggggctcccttgggaagctgaggggtgggtgaggagatggaggttctgtgaaggaagaattgcggttctttgaaaatggaaaagggattccgggaggagacgagggttccatgggagctggggagttccctgcagacttggagggtccgtggtggagatgcgggtttttgcgaggagacgcgggattccgtgagggaagaagtgaggttccttgagattgggacggggaggtcggccaagagagtgaaagtttcatgggaagagaaggggagttcctgaggcgaaaagagggtctctaaggggcgacgggagccttgaagggaggagggccacgaatagaactttctttgcttccctttcacaccagctcagccactgcctcctgagacccttaacctgtgaactgttgagggcaataacgggtctggttcccatcttggggtcctcagattagtaatggagtccccgatctatttttagtatatcggacatcctaatggaaattacgcggtataagactgaacgagttactacgatgtcaagttgttttatttatttttttaacttgggctgggattgtattagtaatagttcagaagttctgatagatggttccatgtctgttaaaatgtatgaggaaaatcggccaggagcagtggctcacgcctgtaatcccagcactttgggaggccgaggcgggcggatcacttgaggtcaggagttcgagaccagcctggccaacatggtgaaacccccgtctccactaaaaatacaaaaattagccgggtgtggtggcgggcacctgtaatcccagctactcgagaggctgagacaggagaattgcttgaacccaggaggcagaggttgcagtgagccacgatagcaccactgcactccagcctgggcgacagagcaagactttgtctcaaaaaaaaaaaaaaaaaaaaaaaaaaaaaaaggtataaggaaaatccccctacccttgccctcagtctgggtaaaggacagatagatagacagatagatagatagatagatagatagatagatagtttgttttgagacaaggtgttgctctgtcacccatgctggagtgcagtggcccgttctaggctcactatagcctgcatctcctgggctcatgcgatctttccgcttcagcctcctgggtagctgggactacaggcggacgccatgacacccagctacttttttgtattttttggagagacgaggttttgccatgttgcccaggctggtcttgaactcctggcctcaggctttcctccttacttggcctcccaaagtgctgtgattacatgtgcatgagctactgcgcctagccaaggagtcaaaattgcacccccattgggaggcagcatgatgtttggttgtgggacaaacatgggccacgaatcaaatccagaaaaatctagatttagaccctggctctgctgttcatttactgtggggtcttaggcaaatttttaagcctgtctgagattccttttcttccatctataagataggtctagtaatacttgcctaatgggtttgtatgaggtctaaagtgtgtaataagtatgcgctataacatgcctgatgcacagtacacattcaataaatagtagttagtctgatacaatataaatcaagcaattaccaagtaatgcaagacaggattcaatcaagtgtaaagtggtggagttgggatttgaaccaagacagtttgactgcagaatccatatcctaatagcaatgctattcctcttccatgaccccacagaatgcatttcaccaaattccatcaaatacagaatttctaccagggaagcagcctcctaatttgtcctctcttgcctagtttcgccaacttgagtctttccagtagatttatcaagacaccattagattgatattatggaaatatgctttcatatgtcactgcaaaaactttcaatggttccctgtttctggcagtttctaattaaaattctgcttttcttttttttttttttttcttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggctttcaccgtgttagccaggatggtctcgatctcctgacctcgtgatccgcccgcctcggcctcccaaagtgctgggattacaggcgtgagccaccgcgcccggcctctgcttttcttttaagacctccagataatctagctccaccctgcctctctattcttatctcccactacttgctaccactcccctcattctagatagatcattctccttgatatcctggatacacatttattcccaccttcttgcctttgttcatttccttctgcttctctctacctagtcaaactccaccacttccaatagagcattcactgatcatcccaatttatgctcacctttttcctcttctgaatatctttagtacttagaaactatgccactcatccagattctgacacacacacacacacacacacacacacacacccctaccccccccaaaaaaacccagaaaaactaagtgtgcataaaattcagttttgtagccaaacatggtgacgcacgtctgtaatcctgctactcaggaggctaaggcacgagaattgcttgaacccgggagacggagattgcagtgagccaagattgtgccactgcactccagcctgggcgacacagcgataccctgtctcaaaacaaaaacaaaaacacctcagctttcttcattctttgttgatggacataaatgtggtttataaatagttttatatactatatgcctactattatcacttgaaaatatttttgagtatttgtactctcgttattagctgcgtggtccttggcagagtttcctgtgcttcctgagcttcagttttctcatctataaaattaggataattaatgtatactttgtaagaccataatgtcataaagattaaatgagattagtccagtccctgatacatgaatggcatttactaaatactagctctcatttgctttctctttaatggccatttattattctatggtattactacttgtattactagttttcatcagtttgttattgttgggctattgggttgtttccagtttcactattatagtgttgctataaacatctctttactaatcactttttttctttgtgattattttcttgaagtctattccctatagttgagatagcagagaaaagggtataaaaagttttatgggctgggcgtggtggcccacacctataatcccagcatcctttgggagggcaaggtgggctcccaaagcttgagcttaggagtttaagaacagcctgggtaatatggccaaaccctgtttctacaaaacaaacaaacaatgtgcgcctgtagttccagctactggtgggggagggggtacagctgagatggggggatcacttgagccagggagatggaggttacagtgagctgagatcatgctactgcactccagcctgggtgacaaagagcgagacaccgagctaaaaaaataataataatagaaattaaaaaaaaaaagttttatggctcttgtcatgcattgccttgcaatctaataagactgcgccaatttcttacaatgccattattgtgtaagagtatctgttttcccagggccacccagacattgggcttaataatttttttaaatttttactagttttctaggtatataatggcaccttggggttgatttaatttggatttctttaatacattacaacgttgtacactatgtgatttagctttcaattatattctgtcttgtacattaaaaaatatttcatgtgttaatcttatctctccaactagattgtataagctctaaattgtgtaacctgaaacaaatgacttagcttctatgaattttatttcttatgaaatgaaatgagggggtgataatctgtaaggttacttccattgttacggttctaattgcttctctttcctccaaatttttttttttttttttttttttttttgagatagagtcttgttctgttgcctaggctggagtacagtggtgcaatctcaactcactgcaacctccacctcccaggttcaggcgattctcctgcctcacgctcctgagtagctaggaatacaagcacccgctaccacacctggcaattttttttttttttttgtatttttagtagagacaggatttcaccatgttggtcaggctggtctcgaactcctgatttcaggtgatccgcccgccttggcctcccaaagtgctaggattacaggagtgagccacagtgcctggcatcctctaactcttgattcagtactcagactatcctaaattctctgcattcatatgttttacctgttgagtacattttctgcagaatagccaggcagatattttaagaatgtaaatttgatcatgttacttgcttaaaacccttcaatgaattttcattgctcttgggatatataccaaattccttattatacacagaattgcatgatttgcccagtttatgcatcaattcctgctattctttcccttattctcagtgtttcagcctcaaggagttcctcctaacatatgcccttggtctctttttttcatatgggagtggagaaaaacttctattcatctttcagattttagcaaaaatgtctcaaggaagtttagatcttgacttagtaattgtgtaaccttagacaagttatttaacctctctgagccttgattttcaagtttataaaatgagaaaagcctcccttctagagttgtggtaaggattaaatgagataatacatatgaaaagcttaaagaaacatttggcacatagtgaataacacttatataagtagaagctggagaaggagatgctcaatatataattgctgagagagaatgcacgaattaagagaagaaagagttggtcatggaaggttctgtgggtgaagaattttttctttttactaattacttcattaaaaaatttactttctagttagacagatggtgaaaaaaattgtacctgatttcagcagaactcggtgtgtacctataatcccagcttcttgggaggctgaggcaggaggacagctgagtccaggagtttaagacaagcctgggcaacagcaacaaaaaattactgattgcctattttgtgctaggcattgtgctagtactaggtggctctgattttaatagatggtaaaaagtgagtaggcagtcttgaggacaggaggaagaatttgagtcaagattcagcccaagagaatagaagatgggttagaagagtgttggctgctggccgggcgcggtggctcaagcctgtaatcccagcactttgggagtccgaggcgggcggatcacgaggtcaggagttcgagaccagcctggccaacatagtgaaaccccgtctctactaaaaatacaaaaattagccaggcgtggtggcacgcgcctgtagtcccagctactcgggaggctgaggcaggagaattgcttcaaccggggaggcagaggttgtggtgagccgagatcatgccactgcactccagcctaggtgtcacagtgagcctccatctccaaaaaaaaaaaagtggtgggtgctaagattagacaggtaaagaagggacccaggtggtgggtcctagggcaaggaagttataatttggtcctgtgtatagactggtaagccttctgaggctaaatatgtctcagaagattaatgatatctgggcttccatttctgttgcagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactggtaaaaatatctatcttatacttggtggcagataaaaacactcatttgatacttacaacaacccagtagagtaagcaaagtgtcatcaacttaatgcctcaggtgaggaaaaatacctcaaggaagctacatgacttccttcagatcacataactagtatgtgacagagctgacattcaaagccaagtgtcctgacttctagtctagtgttcttggctttgtagttgaagagggagaaagggcattggcaaatggaagagaacaagactgagtagctttcttcctcattcttgctttggaagacaaatagtattgggtttttcaccaccactactaccactaccattatcattatcttttacagagctgtgtgccagaaactatgcttaagtgcttaacaaatactatctcctttgatgcttataataattatgaaagcactatttgttttcctcattttacataggtgaaaactgaaattctgagaagtcaagtgacatatctgaagtgaaacaactagctagaagcaaggctgagattcaaacctaggcagtataattacagagcttacacacaaccatgacactctattattcctctaattccttaccttggcctctcaacaggtttgtaaaataggaattcttagtttcattttataggtgaacaaatgaagcattgaagggttatgtagtgaataaggtcatagagtgaataagtggtagagccaggattcaaattcaagtctgcctgactccttgcttgtaccactaggccatgcagcctccccagcaggaaatttctaagactgcttctcccaggaatttagctgtctaggagatactactataccgaatccaaataggacttagaaattccaataattggggtgttgcttctgccacaatctatgagcactcagagttgatctattgtttttgtattgttttgttttgttttgtttttttggagacaggatcttgctctgttgcccagcctggagagcagcggcatgatcttggcttactgcaacctctgccctgcctcccctgctcaagcaatcctgccacctcagcctcctgagtaggtgggactacagacatgcaccaccacgtttggctaatttttgtattttgtatttagtattttttgtaatgatggggtttcaccatgttgcccaggctgttctcaaactcctgaactcaagcgatccacctgtcttggcctcccaaagtgctgggattagtgtgagccaccatgtctggcctgattaattatttaagctagccaataggagcagcttggatgcttcatgggagagttaaattgaaactcactcaatatctttgcccagtttgtgtgatatattgagaagagccttaacctgagagacaagaaatttaggttctcctttcaactctgccattaacatgttatataaccacagacaaggcatttaactaagagtcagtttcctcttccataaaatggggataataattctatccttgtttttctctctagattgttgtaagaatcaaatgagataacgttgtaaaagcacttatttgtttattggaaaacactgtataggtgtgagtggtctattattatactaccattgcttagttgggggccagtttgtcactgaaattcactgtccattgtgtctgttgagactctctttagcttctgctctagagctttatgcttgagctccagccaacacttgggctcatttcccaggctctttaaagatcagaaaacctttaaagatcttcaaaggaggccgggcatggtggctcatgcctgtaatcccagcactttgggaggctgaggcaagagggttgcttgagcttaggagtttgagaccagcctgggcaacacagtgagacccccatctctatttcacaaaaaagaaagaaataggctgggcatggtgcctcatgcctgtaatcccagcactttgggagaccaaggcaggtggattgcttgagctcaagagttcgagaccagcctgggcaacatggcaaaactccctctctacataaaagacaaaaattagctgggcatggtggtgcacgcctgtagtcccacctacttgaaaggctgtggtgggaggattgcttgagcccaggaggcggaggttgcagtgagcacagatcacaccactgtactccagcctgggcaacagagcaagaccctgtctcaaaaagtaatagtaataaaaataaaataagaaaaataaaaagaggaaaaaaaagatcataaaaggaaatgcttgtatctgaatttgttccctggtttgaaagaactcaggtgcctaatggaaaacagaatacacaggccagagttttcaatcactggagagttttccagaatcctgaggccctttctttctagagacaccagttcccctaccacccttacctgaacaggctctggagagcctctctttccccatctgtaaaatgagaggagtagactagatcagcattttccaaagaatgcttcaggaactgctaattactggagatattagtagggggcttcttaattcataaaatgattgagtctgagaaacactacataataaattgcctttgtgtgagattcccaatgtgtattagcatagtaaaatctccaagatgtcctatattagagatacctgattaattttgtttaacataggatttcctgaatttattgaagccccaaacactttttgccagcatgctattgatatcacaagaagcagtattccatggaacacccactggggaagcactggattaaataatctctaaatttacttccagtgcaaaattctgtaactcaaaaacaagacatcctcactccatttttacattggtcactccctcaacaagaattgttaaagatattggatactcagggctgcattaggcattatggatatgggggtaaaaaggcaggagacaagtaccatataggcaattactatttaattattttatgtttatagtaaagcaaaagcaaaatacaaataaattgcattttattataagaaagtaaagtgcaaatatgccggatatgtggttacatccctttgttgcctctatatttttaaatgatatgcttatactgctatttttcatcatttttaaagaaagtattgatttcttactacgatagataagaatttagttcttatatacctctctaacttccttctctcttcttctcaatataattatagctgttttctagttaatttaaaatcagtttacataagaatagcatactgtggttatatttccttttatgtacggatttttatttactctgaagttaataattgcttactgggctgggtgcagtggcttatacctgtaatcccaacactttgggaagcagaggcgggcagatcacctgaggtcaggagttctagacaagcctggccaaaatagtgaaacctcatctctactaaaaatacaaaaaaaaaattagctgggcatggtagtgcacacctgcagtcccagctacttgggaggctgaggcagaagaatcgcgtgaacctgggaggcagaggttgcagtgagccaagatcacaccactgccctccagcctgggtgacagagcaagactctgtctcaaaaaacaataaaagtaataataataattgcttaccgtttttctttttgtactatttaagcctttatcatatatttaatattttccaatctcactatcatatgaaatcctccttttcctcccaaagttctccctcttggagctcacttctttctgttctaattcttactaatgcttttaaaaatgacatcttttctgtgattcgctccaattgatatacttcttatagaaacacattatggctttcttcttaactttatgtcatttagacagctatggtggcattaacaagccacatttgtagctagtttcttgttttggaacatacattgtgtagtcattgaaattatccacaaaggaaatggtgctcttaggaaagtactcccattatccaaaatagaaccatattaaggaataatttggccttttacttttggcttgacacattgcaaatgttcacggaatagtagtatttttagaacttgaagtgaccgttagagtccatctaggccaactctcttcaaagattggtagattaagggacaaagaagctaagtgatttgcctaagggtcatacacctgtttgaagacagaactgagactaatctccagatactctcactcctagtcaactattttttttcactcgtgacactacctcattattctagtagtccagcacttggctgtgacagataaaaagagaaattagccacattagccaaactgatttaaattaactttaaaataccagataaaatgtgttattaggtttaaatgtcccagaccctagtctcatggaatttacattctatttggaaagaccaaatagattggccgggcacaatggctcatgcctgtaatcccagcactttgggaagccaaggcaggtggatcacctgaggtcaggagttcgagaccagcctggccaacatggtgaaaccctgtctctactaaaaaatacaaaaatcagctggatgtggtggcaggtgcctgtaattgcagctacttgggaggctgaggcaggagaatggcttgaacccaggaggcagaggttgtagtgagccgagatcgtgccattgcactccaccctgggcgacaagagcgaaactccatctcaaaaacaaaataaaacaaaacaaatagatctacataaaaacagcctgggccaggcatagtggctcacgcctgtaatcccaacactttgggaggctgaggcgggcggatcaccttaggtcaggagttcaagatcagcctggccaacaagacgaaaccccatctctactaaaaatacaaaaatagccaggtgtggtggcgcactcctgtaatcccagctacttgggaggctgagacaggagaattgcttgaacccaggagacagaggttgcagtgagccgagatcaagccaatgtactccagcctgggcaacagagcaagactccatcaaaaaaaaaaaaaaaaaaaaaagcctgaaaagaattatgggccaaactgcaaagagctacttacacaaatagttcacagaaaggaaaaagccttatagggaggcaggataatataaagattaggagaatgggtgttttggtgtcagactaacccagtttgagtcctatttttgccactaattagctgtctgatcttgggcaagttacttaacctctttgagcctcagttttctcaactgttaaacgtggataaaaatagcttttatctcatggagttgtcagttttgtaagattgaataggataaaaaaaaacatgtcaaattcctggcacattgaatgcacttaaatattagccaccacaattatttatattggaacagtgagaagaccaagcatgtttagagtaaaaggtttatgcagggaacaatttattcattcaataaatgcttactaagaacttattaagtgccaggcactattctaaacaaagttcttgccctcatggaggttatagtccagcttgaggagacagacaataaacatagaaaccagtaagtatatgacaggtagtgatgagtactatagaaaaatatagagcagagtcaggggaaagggaagtgacagtgcagagtgggagctgataaggaaagaaccttttgataaatatgacatttgagcagagatctgaaggaaagtatggagtgtgccacgcagatagttggggtagggaggggaaatgttccaggtaggtggagaacaaatgtgctgctgcctggtgtgtttgaagactagctaggaagttagtgtagctaaaatgtgtgagctagggaagagagagtagtattgacaccagcaggatattagatcatgtcacatcttgaaagccaatgtagactctggccttttattcatggtaaaatgggaaaccactagacaatcttttttttttttttttgagacagagtctcgctctgttgcccaggctggaatgcagtggtacgatctcggctcactgcacccgccatcatgcctggctaatttttatatttttgtattttattttatttttttttgagatggagtctcgctctgttgcccaggctggagtgcagtggcacaatcttcgctcactgcaagctctgcctcctgggttcacaccattctcctgcctcagcttcccgagcagctggtactacaggcgcccgccaccatgcccggctaattttttgtatttttagtagagatggggtttcaccattttagccaggatggtctctatctcttgacctcgtgatccactctcctcggcctcccaaagtgctgggattacaggcgtgtgccactgcgcctggccaatttttgtatttttagtagagacaggttttcaccatgttggccaggctggtctcaaactcctgaccttgtgacccgcccgcctcggcctcccaaagtgctgggattacaggtgtgagccaccatgcccacccacaccactagacaatcttaagcacagacgtgataatgatttggcttctatttaggctctatcttttatattaagaagagactgtagaaggggaaaagtagaagcagggtaaccaattaggaggctattgtagaaatccaggtgatagattgtggtgatttagaccatagtagtagtcatgaagatggttagatgtggtcaaattctggatctattttgaatgaagaacctatggaatttgctgacttggattgggtctggggagtgaaagaggagttacggttgtcatcaacagcggatgaggtccaggtatgggagatcttgactatttttggagatctgtgaaaggattgcatgcagcggaagtcgcagcagaggttaagaggattcatctggatacatatggaaatgggaatgtgaagccagagaactgagagtttgttattcagtcctgaactaggatgctgctggtgggaatggaatggaacaatgacattttagagtgatttgataattttacagtaatttaatctgtataaagggcttagtgcttggcagaaagtgtattagctatttttttcattatggaaagaaaccagcacaggtaactaggtgtgtagatggtggagagacagggagaaagtgaaaggaaagagtcaaggattctcctagtctatataaacactgcctcttttgaaggcacacgttcatctgctccaagggctaaattttccctgcaaaatacagactttggttccaactttctcatgctgtcttccccctggtgtggcagataaatatgttagtgggggtgcatgtgtatatgtatgggaaaatgatcagtgacaaggtattgggatagtcattcagggagagagagtcagtgagggtgttagaggtagctgaaggagtggaagggagttagctagttgaaggaacactggaggactgtcggggatttgggggattaagtaaaaggtttataaggagagggtggaaagagtggttgatggctgatattctgatcatttatactagctactcagtctctactttttctagaagtccccagtaaccaaagcccaacacatttggtatcgttgattccttccattgtttgctttgctttgggttgcctaaggctgtggttatctctgagccacctaaattctcaccctcagctgaaatcactactgtctcttcatggctctcagtatatttcaatccttcttcaggaactggagcttttgagaataaggcaactttaggattgaccctaggacagaagctctgctctcaggatccttgtatgctcctgaatatgaattccatagtatgatatttggagctccccagatccttgtaggcatatgtgtgtgtgtgtatttgaggccaaaaaaaaaaaaaaaaagtccctacctccccatgtcactgaagtgaactccagaatatggacctagataatttagagtccctggacatgaatgataggacaatatactctagggctctgattttccatatcaccttgacaaatctccttgacaaaacatgggcttgcctcaccttctcaaccatccccaccttctcaaatacacacactacatctatatctttactagtttcacaacagcatatctattgattaagatatatttggtaaagaaaaacactcattttgagaaagatgacttcagaccattctcttcctctctctgggccttctctttgtgggcatgatgggaaatgaactacagatactctgcaaggtccctttcatctctaatcttccagaattctatgactgtttctgaagagaggaagcagtttttagaagttctgttgcaacctgtagtgactctgtggtgactcagtaggcgggttgaatttctgttgagatggtaagaaagagggaggattttgtttatttatttatttatttaatttattttctataatgatgttgacaccataaagcaagaattttagaaggtttggaatgaaggggctgaggaaggagtctgttcctcttgcctgagggttgtttgtggctggtagcataaatactcaaagctaatgggagatacatgggaaatacctgttgttgggaacagtctttctccacttgaatgaggtgagcagattgtggaggtgagctggaggatttcatgtttaaggtggatttctaacctgcttctctcatttctccctgagttttatgacccttgacactttacagaacacctccctaaagtggtgaaaatgagacaagtaggctgtactttccgagtcactttttttggaagtaggtggcatatgaataataaatgtattgctctgaagactctgtcttgaggcctgtttcagtgtcctgagcttcatatcagctacctgagtttgtgtctgggccaacttcttatactggcatgttcagtaaacatttaatgaaaagaatggctttagttaatgcccttttctaagccttctttttcccacttataaactgttagggatgtacaagactcttttttaagttacttctggcactgaccttcagaatttctgtcacaaatgcagggaactgcctggataaattctctacatttctgggagaagttaggggagaggaggaactggcctcctctcctttgaagatactaggtggtcagatgggagcaggggttcttgccttatggcagccccacatttataacaattaactcagaaggcgtggagttgaggatgggccttcccccacttcctggatttggtttgggagaggttgggcactggtaatgatccccggtgtctcacatcttgaacctctgagaattcaagactctcagtttcagtccttagaggtcatttggtccaattcccacacaaatcaggaattgtagtaccaatatcccaatccctaacaatccccataagttatcattctgattctgggtcattctcattcaattcctacatctctaccttaatacttactagttgggcaagttacctcacctctttaaacctcaattttcatgtctgtaaaatggaaataataagtcctgtgacatagattgttgtaaggaagaattggaataatctatataaagggcttagtgcttggcaaaaagtgtattagctatttttattattatgccaaaaccctatacctaaaacaggtaacagcggtgctgatctggttggagcatggatgggaggcctagagccacattctgtaggcttctccaccctgttactgtgttccctgtgaggtgtgtgtctggaatccctagggatttgcaaagctcagtttgaaaacccctgatctagtccagtgttcttgttttataaatgaagtgatactgagtccacagtctcaggttcctcatatgatgtggcttcctaaacaaccatgtcggtctcccctggatatactttagttggccaatatctctcattaagtattccagctatggtctgacttgaacagggtactattaccattctttcactttacatatctaagattatattagcctcattgacagccacactctccagtcagtttataatctctcataatacttaagattttccttttctttctctctttctctctccttttcctttttcctctttctcctttcatttccttccctttccttcccttgtttgtctcactctgttgctcaggctggagtgcagtggtgcagttgtggcccactgtagcctcaaactccaaggtccaagtgatcctcccacctcagcctcctgagtagctaggagcacagtcatgcaccaacacaatcagcgaattttatttttatttttattttgagacagaattttgctcttgttgcccaggctggagtgcaatggtgtgatcttggctcgctgtaacctctgcctcctgggttcaagcaattctcctgcttcagcctcctgagtagctgggattacaggcacacaccaccatgcccagctaatttttttttttttttttttgtatttttagtggagacgtggttttgccatgttggccaggctggtctcaacttcctgacctcaggtgagcttcctgcctcagcctcccaaagtgctgggatcacagacgtgagccgttgtgcctggccagcttggaattttgaattagagaaggtacaagagaagactgcaaaatctcagatataggagggccttggactacctattatctctttttgggatataaagtttttagaacagccctcttctagggttctaaggtctggtctacttatggttttactatcatggtttattatcatggttaccttatggttttaccatcttggagcatcattattttatttaaataaaataaatacaaccctgaaactattcaccctggaatactttacacacagagttgcccgtacagaaaacatctctagagcatatgaacacctgcatttctaagtgtgatttttttgaccagagactaatttttgaaaccaacgtttgcttctttttgaccatgatattttaatacatgaaaatctatccaaaggagcagtcacagagggttcttgttgaactttagtttctgagctgcttttgaggatggttacttgaggtgtcctccaaactgccacatatagtgagttagagaatctgccaggcacagtggctcatgcctgtaatcccagaactttgggagactgaggagggaggatcactgaactcaggagtttgagatcagcctgggcaacacaggtagaccccatctctataaaaaattttaaaattaggccaggcgtggtggctcacacctgtaatcccagctactcgggtggctgaggcaggaaaatcgattgaacctgggaggcagaggttgaagtgagccaagatcatgccactgcactccggcctgggtgacagagtgagactctgtctcaaaaaataataataataaataaaaaattagctgggtatggtcatgcatgcctgtggtcccagatatttgggaggctgaggtgggaggatttcttgagcctgggaggttgaggctgcagtgagcggtgatcgtgctactgcactccagcctgggtgagaccctgtctcaaaaaagaagttagggagtcctaatacaacatctggatttgttaaaaatctgtctagttgttttcatatgatgggaaacaaactgacagaaatctaattttatttatatggatagccatgctgtacttgctaagaccacaagaataggctcagagagaggggaaagtttgtgtaaattatacattgaattaggggtaaacaatctagtctgatgactccatattcagagccagggtttcccaattttagtttatgtaaataattacctgaggatgtcgttagaaatccagatttctggaccctatcccagactattgagttagaatctccagaggataagacctctgacttgtatttttgtaacctcctcagacaattctgatgttggggggagggacaaagtaccattgaaaaattatttagattaataaccttaaactcttaaaattatatacctaaaagaattttgaaaaattatgtaactcttgacataatgttcatatctaaaaattttatcataagatttaaaaattgcaaaaaatcgaatttccaaaacattttacatattatatacacacatatatatatatgcacatataggttatacctctttcaaaacattggcactgcaaatttagctcatataatttatagaagacatctaccatacaacctgttttgcatagccagttatcacccaacataatcagccaaatcagatctactgtgttagaaattgcctaacttctttcttaagataaatatgttaatatatgactctgtgataactgtttcacttctgagttgtaattctaagagatataaggcaagtagtcttgccatgagtttgttacgtggatgaattaagatgccaattctttcaatactgatttctcagagaagctctcattgatttgctttcttggggctctccctcagaagttatacattctcaaattgtccctttgtttaacactttgttcataccctgtcattgtaccataataaagtttgagataagagagagctatgacattcttgtttaacgtgggagaagggtaattgtaaaagagagtgagaaagaagaaccaactcagacagatcattgttaggaaatattacatatggaagttgaggatctagacatttattctcttcatatttttctgtgcaggtactcacaggaatagagtaccgtagattgaggactaatgatttaaactgcctttgacctagataatagagaaccattgtaatgaatatttttgcatgtgtctattatacttgagagacttgatgtacacataaaatgatgcccctggattttctttccactttctgtttctgctctaggcatattcctcttttgggctgcattccaaatgctctgccctcattcacttgttataggtaaggccagcatgggacacaggatggtaggaacaagtgtgtgattcccctcctgtaagtaggcatgtaggcagtgagaaaagagaagaggtacacaatccatcgggcaccaaagccactttggccaaggggaacatgcaaaaggtatttggatcaaggcctgaaaatagctggcaagaggacagggtacaataatagcccagactgcagggcaggagtcccatactctgaacctcagctccagggttctcttccagcctcttcacagagtcccagactgagcccactgtaggatctcaagaaacacttcttgacatgattccaaaatccattccacaaattccactcttgtctttcctctgcctgtccagcatctatcttgtttatctgtatcctatcttatcccctctccttccatactttctctctttgatcatcttggatccagctggtcatataagcagagataagtttgttcatttatttattcattcttttatctattcattttacaattatgtattaagtgctcactgtgtattggcctttgtggtaagcactaaggagaaaacatataaaaagatatcctgtctgccattaaggaactcataatccagtgagggaaacagatgtctacataggactctagtgctagaaaaaaataagtgcccaagtgttgtctttagaaataaacaggctgggcgtggtggctcacgcctgcaatcctagcactttgggaggccaaggcgggcggatcacttgaggtcaagagcctggccaacatggtgaaaccctgtctctactaaaaatataaaaattagcctgtggtggcgggggcctgtagtcccagctactcgggaggctgagacataagaattgcttgaacccgggaggcggaggttgcagtgagccgagatagcaccactgcactccagcctgggcaacagagctagactgtctcaaaaaaaggaaaaaaaaaaatagaaagaggcaagaatgaatgaatgaatagtgcttaatctttctaatgaatgaatagttacaacctttctggaaaggaaggtttgtaaagatgtctgtattttccaaattaatctgtacatttattgcaattccaatcaaaattgcaattatattttttattgagatataatttataccatataattcacccatttaaagtatacaattcatatttttaatatatttgcaaaggtgtacaactttcaattttagaaaattttcatcacccccaaaagaagtgcaatactcattagcagtcatttttcattttcccccaacttcttctcctccagctctaggcaaccactaatctactttctgtctctaaggctctgccttattctggatgtttcatataaatggaatcatataacacgtggccctttgtgtctggtttctttcactaagcataatgttttcaaggttcatccatgttataggccggatgcagtggctcatgtctgtaatcccagcactttgggaggctgaggtgggtggatcacctgaggttggtggatcacctgagcttggcagtttgagaccagcctggccaacatggtgaaaccccatctctactaaaaatataaaaattagccggccatggtggtgcatgcttgtaattccaggtacttgggaggctgaggcaggagaattgcttgaacccaggagacggaggttgcagtgagccaagatcatgccaccacactccagcctgggcaacaaagtgagactgtcttaaaaaaaaaaaagttcatccatgttataccatatatcagtacttcatccttttacattgctgaataatgttgcattgtataactgtatcacattgtgtccggaattggtgggttcttggtctcactgacttcaagaatgaagccgtggaccctcacggtgagtgttacagctcttaaggtggcacgtctggagtttgttccttctgatgttcggatgtgttcggagtttcttccttctggtgggtttgtggtctcgctggctcaggagtgaacctgcagaccttcacagtgagtgttacagctcataaaagcagtgtggacccaaagagtgagcagcagcaagatttattgcaaagagcaaaagaacaaagcttccacagtgtggaaggggacctgagcgggttaccactgctggctggggcagcctgcttttattctcttatctggccccacccacatcctgctgattggtagagccaagtggtctgttttgacagggtgccgattggtgcgtttacaatccctgagctagacacaaaggttctccacatctccaccagattagctagatacagagtgccaacacaaaggttctccaagtccccaccagagtagctagatacagagtgtcaattggtgcattcacaaaccctgagctagacacagggtgctgattggtgtgttcacaaaccttgagctagatacagagtgccgattggtgtatttacaatccctgagctagacataaaggttctccaaggccccaccagagtagctagatacagagtgtccattggtgcattcacaaaccctgagctagacagagggtgcagattggtgtatttacaatcccttagctagacttagaggttctccacttccccaccagactcaggagcccagctggcttcacccagtggatcccgcactggggctgcaggtggagctgcctgccagtcctgcgccgtgtgcctgcactcctcagcccttgggtggccgatgggactgggtgccgtgagcagggggcggtgctcgtcgggggggctcgggccgcacaggagcccacggtgggggtgggggaggctcaggcatggcgggctgcaggtcccgagccctgccccgcgggaaggcagctaaggcctggcgagaaatggagcgcagtgctggtgggctggcactgctggggtacccagtacaccctccgcagctgctggcccgggtgctaagcccctcattgcctggggccggcagggccggccggctgctccgagtgcggggcctgccaagcccacgcccactcggaactccagctggcccgcaagctccgtgcgcagccccggttcccgctcgggcctctccctccgcacctccctgcaagctgagggagccagctccggccttggccagcccagaaaggggctcccacagtgcagcggtgggctgaagggctcctcaagtgccgccaaagtgggagcccaggcagaggaggcgccgagagcgagcaagggctgtgaggactgccagcacgctgtcacctctcaacgttatcacatttttttctttctttctttctttccttctttctttctttctttctttccttccttccttccttccttccttccttccttccttccttcctttctttttctttcttttctttcttttttgtttttttttgagatggagtcttgctcttgtcgcccaggctggagtgcaatggcatgatctcggctcactgcaacctccgcctcccgggttcaagcgattctcccacctcagcctcccgagcagctgaggtacaggcactggccaccacgcccggctaatttttgtatttttagtagagacggggtttcaccatgttggccaggctggtcttgaacacctgaccttgtgatccacccgccccagcctcccaaagtgctgggattacaggcatgagtcaccacacctggccccacatttttctttattcattcctcaattggtggacatttgggttgtttacactttctgatgtcatgaataacgctactacaaacctttgggtacatgtttttgtgtagatgtatgttttcaattctcttgggtatatagctaggagtttaattgctgagtcatatggtaagtctatatttaacctattgaggaactgccagactgttttccaaagtagctgaaccattttatattcccggcaatgtatgaggtttccaatttctgcacatgcttgtcagcacttgttactgtctgtttgtttgattatggccatcttagtgagtgtgaagtgggatctgattgttattttgatttgtatctccttgaccatgcctgaccttttttttttttttttttttttgagactgagtctcgctctgtcgcccaggctggagtgcagtggcacaattttggctgattacgacctctgcctcccaggttcaagagattctcatgtgcagcctcccaagtagctgcgactacaggtgcgtgccaccatgcccggctaaatttttttttttttttttagtagagatggggtttggccatgttggccaggctggtgtcgaacttctgacctcaggtgatcctcccaccttggcctcccaaaatgttgggattacaggcatgtgctactgcacctggcccattaactgccttttgaagactggccggtacagtcctggctccctcaataggtgaggaatcaatgtttagggagaaatttcataaatagtccactgattgaggctatttactctagtttcatcagttttgagttggtgaaaagcccgtccaaatttgggtgataggatgacagttgattccagtttttgaatcaggagctgagtgaggctgcattagggtctacaagttagatatcatttgaaaccagaaatctgtggtgttttcaaaaggaactttttctaaggaactaagggaaaaccaaacagaatgatgaatttctgttaagtacactaaaattccatccttggtagttgtcaacctcacagttctcagagttcctacatttttatttttttccttatgctaattctgaatttggaaacaataccccccttttggaggccatgtcatttaggaggagaaggccctgaactagacatttagactcaagaactgtgctatccaacatggaagccactagctacatgtaactattgatatttatagtaattaaaattaagtaaaataaataatccagttcttccgccacatttctagtgtttgatagctatatgtggctagtgactaccattttggacaacagtgctttagaatagtgttgctactaatttgtaagtaaccttgaggtcatcactttctatttctgtgccataggtttctcaatggtaaataagagtggtgagtctcaaaagtaccatcctcttctggaattctttctttttctcttttcttttctttctttttttgacaggatcttgctttgttgtccagtctagtctctaactcctagcttcaagtgatcctcccacctcggcccctaaagtgttgggattacaggcatgagccaccatatctggccctcctctggcattctgagtaatctgtggttcagtttttggggtgtgcctccatctacctcctccttcagcccttcttgatacttactgcagctagggcagaagcacccagagggaacattaggctgctaattagtcaaggtacattgctcccattccctggtgaaagggaaattgacttgtgggtatacttatatcttgagtgctccacaattgtgcagtgctttatggatcacagaactctttcacattgttttttcattttatagaatcaaagaatctcaaagttggaagggctgtaaaggtcatctcaaacttcaataaccatgaattatatggggagcttatgcaatgaaaatttcaaggccccactccctggagaataatctagtagaagtaggtgtcagggttaccctggcccaacctgaacaatcctgtgctgcatgggaacttggtactgcattattaacactatctgaccactctttgagaaacactggtcttgcttggtccccagccatattgtggaggctgctctttggtatcgctacaaatcccagattcaacatgatatctccagggtcaggaaactcctgaaggagtgccttccatctttggacatctctaacagaaaggttttttttttaatatggagctctcccaattgatgtagattttccatttatagttatactacattagtctacttttccccataatgatcctttagattcatgcattcattcagcaaaaatttactgaacacctattatatacaaggttctgtacgagacaatgagggattcagcagtgaacaagaccaacttggcctctgccttcagaaactgtcttctgtctagtagggaagataggaaattagcaaaaataataataagtaaacaagtaatattaattctattaataatattaacaataacaataagtaaacaaataacaaaagaagtatagtttgagaaaaatgctgtgaagaaaataagcagtgttatgatgaataacaagaagagctgatctacttagggtggtcagggaaagcttcactaggaagtgacatttaagctgagatttgaaacacaagaagagttggggaaagatagttaaagaatatggcatgttctatcagtcagaaggccagcatgtttggagcctagtaggcagaataggagaatggcacaagatgaagttggggaggatacaaggcatagcaggagtgcggattttcttctatatgcagtggaagctgttaaagggttttaagcaggaggtgatatgatctgatttgtggtttgttttattgttgtttaattaattaattaattaattaattaattttgagacaaggtctggctctattgccctggctggagtgcagtggcaacatctcagctcactgtaatctccacctcctgggctcaagtgatcctcccacctcagcctcctgagtagctgaaactataggcatgtgccaccacacctggctatttttttttttttttttttttagtagagagagcatttcgctatgttgcccagtctggtctcgaactcttgggctcaagcaatcctcccaccttggcttcccaaaatgctgggattacaggcatgagccaccatgcctggccaatttatgtttttaatagatcattctgtggccgggtgcagtggctcatgcttgtaatcccagcactttgggagccaaggcaggcaaatcacttgaggtcaggagttcgagaccagactggctaacatggtaaaacttcatctctactaaaaatacaaaaattagccaggcatggtggcatgcacctgtggtcccagctacttgggaggctgaggcaggagaatcatttgaacccggcaggcagaggttgcagtaagtcaagatcacaccactgcattccagcctgggtgacagactgagactctctcaaaaaaaaaaaaaaaaaagatcacagatcatgctgggtgatgtgtggactggaagggaacaagagtgaagtgggaaaccagttaggtgggcattgtggtcatccaggcaagagatgaaggtagcttgaccggggtggagacaatgaagatacagatttttgagacttgctatcacatctctcaatatcttctcttccacaaaataaacagttcagtgttcctctcatctcctctcataacaggtttggtgtctcttctcacctgggtgtttctcctcctgtttctcctccatctgattcctctgtaaagaactcagtctttccctcagctgtttcttcctatcctgtgccttgcttgtagttctagggaattaaaatcttcaattcaatgactatcgttctcatataaagaggggagctgggtgcagtggtgcatgcctgtagtcccaactactctggaggctgaggtgggagaatcatttgagcccgagagtttaagaccagcctgggcaacatagtgagacattgtctcaaaaaaaaaaaaaaaaaaaaaagttggggggtagcaccagtcttccctgtcattagtcaattaccagtctttcaattattcaaccatgaccctcgaatacctattgtgccaattgtgcttggaggagacagagaagaagacatgatctctgccctccaagagctcagggtataatgggaaagataaggcccaaataaatataataaaagctagaaaaacagatcacaaagaaagtgagataaagggctttgggaggaagaaagaacttttagcttttgggtaggtgagaaaaagagaaactaacaaaaatttcatggaaaatgttaattcagagaacctggggctggagaggagcgcagggagtatttttttttttttaatgtggtgatcaaagataaccttactgagaagccaacatttgagcaacgactcaaagatagggaataagtcatgtggctatctagggaaagaacattccaagtagagggcaaaggctctgaggttaaatgttcttggtgcttttgccaaacactggggaggccgtttggctggagcagagggaaagggagaggaagagagaatagttgtatgtgaggacagagaggaaatgagggactagatcatgtaggccattgtgaggactttgacttttactcaaaatgaaatgggaagtgatctgagcattctgagcagaagggtgacataatctgaactacctaatggtagttttggactaggatggtagaaatagatgtgaagagaggtagtctaattctaaatggattttgaatcaataatgggttaaagtaaatttcgagagtgtgagaatgaagtagttggagaagactccttggaggaggttccctaggggaagaagatgagaaggactagtgactgtgtaccatgggttgtcacaccaaccatatggcctccaggtgaaggaaaagtagtttggtttataccaagggttccccatgttatcccaccagctaaatttctcattaatagttttgtttgattcacagtgtttaaaccttttttttttttttttttttttggtaggcaggggcgagacagggtctctgttgctaggctagagtatagtagcatcaacgtggctcactgcagccttgacctcccgggcttatgtgatcctcctattttagcctctcgagtagctgggaccataggcattagctaccatgcttggctaattataaaattttttgtagagacaagttctcaccatgttgcccaggccagtcttgaactcctgtcctcaaacagtcctcctgctttgccctcccagagtgctggtattatggcatgaaccactgcaactggccttaaagctttaaaaaaattagtggtcaacacatataaattcagaagttttttttttttttttgagacggagtctcgctcggtcgcccaggctggagtgcagagtgcagtgcagtagtgtgatcttggctcactgcaagctccacctcctgggttcacgccatcctcctgcctcagcctcccgagtagctgggactacaggcgcccgccaccacccccggctaattttttgtatttttagtagagatggggtttcaccgtcctctcgatctcctgacctcatgatccgcccgcctcagcctcccagagtgctgggattacaggcgtgagccaccgtgcctggccaattcaaaagttttgacaaaaatagattccaggctgctattgaaaaatcgaaaaaattgacaacattgagccctgattcctagcaagcaaaagctgacaggaaccaagtttaggtactagatgcctccttttgccagagcatgcatttgccagttttcctgtccttccccttccctattgttcccctgaaactgaggctaaggtttattatacatgtgctgctgttttcttatagggaagtggaaagggaactatttcttatctttatcatatattttctttcatgtggtccacttatttacattccgtgcctagatcctgccaatttttgagcttgcagctcctggtgtagaggaaagaggcctggaccttaagtcgtggtccctgctctgctgtggtaacccaccctgtgatgccaagcatagctaatagcctctttggatctcagagttaagagactaaattggatgttcttttaagagttctgatatcctggccgggcgcggtggctcacacctgtaatcccagcactttgggaggccgaggcgggtggatcacaaggtcaagagattgagaccatcctggctaacacggtgaaaccccgtctctactaaatatacaaaaaattagctgagcgtggtggcaggcgcctgtggtcccagctactcgggaggctgaggcaggagaatggcgtgaacctaggaagcacagcttgcagtgagccgagactgcggcactgcactccagcctgggtaacagagcaagactccgtctcaaaaaaaaaaaaaaaaaagagttctgatatcctagagggcttgggattttgcagtaggccaataccctgcccctcacctttcccaaccagccaggggccccagcctggtgtgtatgtcagagaaagaagacactggaatgagtaaggtgcttatatcaataatgtataacttgagcccatagccaaggagaggaatgcacactgtggtgtgtgtgtgtgtgtgtgtttcacggttggaagtgggctcaaataagttgtacttgcataggttgtgcttatttcttcttgtgcactctctatgtactaggctgtacttgaggtgctagggatgtagcagtgaagaaaacaaataagatctctgctgtcagctgggtgcagtggctcacgcctgtaatcccagcactttgggaggccgaggcaggcggatcacctgaggtcaggggtgtgagaccagcctggccaacatcttgaaaccccgtctctactaaaaatacaaaaattagccaggtgtgatggtgggtgcctgtaatcccaactacctgggaggctgaggcagggagaattgcttgaaccctggaggcggaggttgcagtgagccgagatcgcactattgcactccagcctgggtgacagagcgagactccatctcaaaaaaaaaaaaaaaaaaaaagatctctgctatcatggagcttatattccagtgaagaaaacagataatatataagtaattaacatacatgagataatttcaaataatggaacgtttcatgaaaaaaataaaacagaatgtgttttttttttttgagacagtcttgccctgtcacccagggtggagtgcaatggcgcaatctcagctcactgcaacctccatctcctgggctcaggtgatcctcccaccacagcctcctgagtagctgggtttacaggcatgcgccaccatgcccggctaatttttgtctttttagtagagttggggcttcgccatgttggccaggccggtctcaaactcctggcctcaagtgatctacccacctcagcctcccaaagtgtgggattacatgtgtggcacctggcaaaacagaatgatttgatagagagtttctgaaggggcacactgtgcacataggtggctacatgtatatggtggttgtacttgcagatacagataagtccatgtttgaatcctgggtgcatatatttatccttgtttgtgcctatgtgtgcagatgggcagcttttatgcctagaatgtttgtatatttatatgtgattttatacaagtgagcgcacataggtgagttggtatgtggtttgcatatggggacacatgtgcttgggtatgtatatgttggcattcagccataaccggagacgttctgaagttcctgtggcacttgtcagtgagccagttaaggaaatggcttttctgcctctggcattcagggccgtttgccagcttcctctctccctgttctttcccactttagtaagctccctgtgtttggcttctctcatccctaggagggttaaagcctactgactcatcgagccaggaactggaaaaaggctgataatcttctgtgtgacctctgttagtaagaaaaggcctggcttccctgccagtccctgtccttcacactatgagggagagtcctgacttgaaatcagaagacctgagcatctattcttggctctgccacttattattgtgtgaccaataatctctctaggtttcagttacctccttcataagtgctctgtgcagtaaggaaggagaggggaagcaatggtctgtggtgctaagggagagccagatggtgctggtgtctgaaggaggagggagaatattctgagcaggggcaatgatgtggccaaaagcgtggaggtggacctgaacttgccaagggaaaccagggatccacttacagtaaaattcaaacttcttactattgcctacaaggctctacgtgatttggctgctgcctacctctcattcttacccaacttcttgctcactgaaatctagccatactgtctttctttctttctttgaaaaggtctcagtgccttttcacttgatgctccttttccccagaatactcttcccaagaattagtatgattgcctacctctcattattcaggtcttggctcaaatatcacctctccagagagaggccttccaggaccatcttatttaaagtagttgttccctaatatttatcaatatttaaaatgcacacatcagccaggcacggtggctcacgcctgtaatcccagtactttgggaggccagggcaggtggatcacctgacgtcaggagttcaagaccaacctgaccaacatggtgaaaccccatctctactaaaatgcaaaaattagccaggtgtggtggtgcacgcctgtaatcccagctactcaggagtctgaggcagaagaattgcctgaacccaggaggcggaggttgcagtgagccaagatcgcgccattttactccagcctgggcaacaggagcaaaactccatcttgggaaaaaaaaaaaaaaaaagcacacatctcttgaaccaacaggtccacttctggtaattcatcctacagatatacttgcaggtgagtaaagtgacataaaaataaaaatattcattgaagcatttatttgttaaataaattacagtacatacaaatagtggaatattttgcagctgagaaagataatgaaatagctctttaagcttggcaccgtggctcacacctgtaatcccaacactttggaaggaaggctgaggcaggaggattggaggatcacttgaggccaggagttccagactagcctgagcaacatagtaggatcctgtctttgcaaaaaaaaaaaaaaaaaaaaaaaggtagccagacatggtgactctggcctgtagtcccaactgctcaagaggcagaggtgggaggatcacttgagtctgggaggttgaggctgtagtgagctgtgatggtgccactgcaccccagcctgagtgacagagtgagaccctgtctcaaaaacaacaacaacaacaaataaaaaagagaaatagttctttaagtcttggtgaagaatgatatcaaggtatattgttaaatttgaaaaatcaagatgatcaatttctacacataagatttgtgcattttattgaatgcatataataattaacaaaagatacagaatagtgtgtattgtatgccatcatttgtgtagaaaaaatgagactatgtaaacaaatgcatgtagtatatatgcttgtctgacagacctgtcccttaagtagagcagttcttcctacccctgttaccctgtgcttgactggggactatgaggtgttcatctcttttctgaacaacattaaaatccttttttttttttttttgagacaaagtcttactctgtttcccaggctggagtgcagtggtgtgatcgccgctcgctgtagccttcaccttctgggttcaaatgatcctcccgccttagcctcccaagtagctgggactacaggcgtgcaccaccatgcccggctaatttttgtatttttagtagagatggggttttgccatgttggccaggctggtctcaaactcctgaccccaggtgatctgcctgccttggcctcccaaagtgctgggaatacaggtgtgagcctctgtgcctggccaaattttttttttttttttttttaaacagagtttcactcttgtcgcctaggctggagtgcgatggcacggtctcagcttgctgcaacctccatttcccggattcaagcgattctcctgcttcagcctcctgtaaaattcagttttttaacattcaattttcaaattttggtcttcaatgatatctcaagggtcttattaaagatcataatgatacagacttcttgcaaagtaattattttggtcattccacactagttgaattaccctagccctgtgtcctacaaagaatggtcctgtctgaatattgattgtttctggaaagtcacacagaatattggtaactgttttgccctgggcatggtggctcacgcctgtaatcccagcactttgagaggctgaagcagttttgcttgaggccaggagtttggagaccaccctggacaatatatcgagactctgcctctatgaaaaattttaaaataaaaaaattagccaggtgtggtagcatgtgcccgtagtcccagctactcaggaggctgaagtaagaggattgcttgagcccaggagttggaggctgcagtgagctatgattgtgcctctgtactccagcctatcaatagagtgagaccctgtctctaaaaaacaaatcacaaaacccaaactgtggtttgccagtaggcagggtgattgggagataggagtggggagaacacttctcattatgtatctttttatgtagtcccacttgtatgtattacttattcaaaaaaatcataaaattggaaaaaaaccactaagggaaacatttatttatttattttttgagacagggactcactctgttgtccaggctggagttcagtgacatgattacagctcactgcaggcttgacctccagggtacaagcgatcttcctgcctcaacctcctgagtagctgagactacaggtgtgcaccaccatgctcagctaattgaaaacgatttttttttttttagcaatgaggttttgctgtgttgctcagattggtcttgaactcctggtctcaggtgatcctcctgccttggcctcccaaagtgttgggattacaggcatgagccaagagatcttcccatctcatctttctgagtggctgggactataggtgcatgacaccacactcagctaaaattttttttttttttttttgagacagagtttcattcttgttgcccaggctggagtacagtggcacaatcttggcccactgcaacttccgcctcccagattcaagtgattctcctgcctcagcctcccgagtagctggcattacaagcatgcactaccacacccagctgatttttgtatttttagtagagacggggtttctccatgttggtcaggctggtcttgagctcctgacctcacgtgatccacctgcctcggcctcccaaagtgctgggattacaggtatgagccaccgtgcccagccggatccagctcaatgtttttagagatgcggtcttgctatgttgccaggctggtcttgaactcttggcctcaatagatgggcccactttggcctcctaaagtgttagaattacaggtgtgagccaccgtgcctgacccaagatagtatattttttaaaagtatttctccctagtcactcatttttatatcattctgctctatttataatgcttatcataatctgaaattatcctggttatatttgttatttgtttattacccacactatcattggaatataagctccatgatatcaggtatcttacttatgttgttcattggtgccttatttcttcttttttttgtttgtttgagacggagtcttactctgtcgcccaggctggagtgcagtggcgtgatcttggctcaccacaacctccacctcccttcaagctattctcctgcctcagcctcccaagtagctgggattacaggcgtgtgccaccacacccagctaatttttgtatttttagtagaggcatggtttcaccacattggccaggctggtctcaaactcctgacttcaggtcatctacctgcctcagtctcctagtgtgttgggattacaggaaagagccaccacgccccgcccattggtgccttatttctatacatgtagatagcacatagtagttgttgaataagcaaatgaatgcatgaaggaatgactgaagtaaaccaggctaaagcctaggaaggagtgggaggcaaggctgaggaggtagacagaaatcacctgataaaggatggcgattctcaaactttatttatttattcaagatggaaactcactctgtcatccagactggagtgcagtagtgtgatctcagctcactgcaacctctgcctcctgggttcaagggattctcgtgcctcagcctccccagtagctgggattacaggcacacaccaccacacccagctaatttttgtatttttagtagagacgcggtttcaccatgttggccaggctggtctcaaactcctgacctttgatctgtccaccttggccttccaaagtgctgggattacaggcgtgagccaccgcgcctggccaattctcaagaatcccctactaattccttgtaccatcttgtaataaagaagcagatccttggaccctgtgattctaattcagtatgtttgagctggggcccaggaatctacaaatcctctagatgatttaggcacaagtgatctggagaccctactctgaataatgcagtcttgatgcctcatcagaaggaatcacatctgtgatttcacttctccttaatacattactaggatggaagagaaggggccgtcactccatttcatcaaggatcagagatggacagtgcattttctaatgacatacaacatgtgtataaaatatcttgaatggccaaagtatctgacccgtcagctcaagattggtgatggcaagattgatggtgggcagatagctcatcctcatagaacagttccaggccttagtgtcactgaatggattttatgactctgcctgtttcttgtttggggaagaagttatacccctaatcactggttctttctggtatgtctcagggagggcaatgagccaggggagaccactcagatcacataccatcagcttctggtccaagtgtgtcagttcagcaatgttctccgaaaacagggtgagtgtgggggtgtgggaaaggactgggggtctggccttggggtatctgagtatctgagacttatggggagagggcaagggatggaaagaatttggtaacagaggaagagaacaggtcagctgggagggaggccagctggatgggagggagcaagtagcagcaagaagggttcatggttcatattctgtgcttttacctgcaggcattcagaagggggaccgagtggccatctacatgcctatgatcccagagcttgtggtggccatgctggcatgtgcccgcattggggctttgcactccattgtggtaggagtttgggctggtgaaaaggggcaggcgggggggtggggctctggagaagtaggttgggcctagatgatggagggtcttaaataacaaactaaggagcttagaaggtttgtgtcataggtccatattagttattcagtttcttctaggaccctggcttagagatcctgaaagttccatgagcaacccctttcttcattcactcaatccctggggctttcttctctccctcagactttcttcccttccctagtttgcaggcttctcttcagagtctctatgtgaacggatcttggattccagctgcagtcttctcatcactacaggtgactaattctctcacctcttctccagaaccccccatacctcaagccttggtctccaatcagctcattggtatttggggctactcagcatagagggtagagactgcctgccttttctctcctggtcccacctcagctgaccctctgtcagctcgaatcagctggaagagccagagttaagaggcctactcaggaagggccctatggacattgtgcccactaggcagcatggggcttactaaggcctggaatgtctgttgctccccaaagatgccttctacaggggggaaaagcttgtgaacctgaaggagctggctgacgaggccctgcagaagtgtcaggagaagtaagtgtgtttggctactgtctgagttgactgagcctttccccagtgccaggttccctttgtcccctctaccctaaatggacatgggtgggtcttgccaagttccctttgagccaacaaggctaccactttaggcttttctcttctccaggggtttcccagtaagatgctgcattgtggtcaagcacctggggcgggcagagctcggcatgggtgactccaccagccagtcccccccaattaagaggtcatgcccagatgtgcaggtgagtctggcactgctatgcctttctccaggctcaaattccttcacttttcctgcctagaaaattcttgatgtccttctttgcctgctcatcagtatactgaggatccaggagcaattctaggaatgcctcctctagcagggctaggtgggaactggaagactttgaccttgactgtgggtagagaggcccttgtaccttgagaacatagcacaagcgattgtaagggagactcctatgctggttggggtatccttgtgggcacaggggatcctcagggcctaggcttgtgttagaaatgtctaacttgagtgacaatatatagtcatctccattactaggctgtgatgtggggtgggctatctttgtggcctaagggatgcccaccttggaaggaccagagtccagccctcacaatatggcctttgttagctttggacccccaggcttctggtgggaatggtagaaatgcccagtgatggcctccaggctgagcagcatgagggatcaaagttctggggttgagtaagagtctgtgacttgaggctccctgaggggtcttagggctagagaggctgtagtctagtttagggaagttggaaagcccaatcagtgttaggggttttacatatataggggctggaatcaggatcaggaaaatggaagctgggaggaccagtgagaagggagtttggggtttatgacacactgaccctttcctcccactccctgtatacttggaccctcctcactacccttttcatcctgggctcttaacagggtaaactgaaagagaaatccaagcgtgttcagccccaggtatccatttctgcactgccgtgggcaccgcttctctgtttgcttgtctgtgtgctcatctgccctttgcctgtttgccccattgaggtggctgccagacctaacctccttccccttgcccctgggcaacttgacatctaagccactgaagggtggtgaaattaaatgtccgttactgcctctgtgaattggtatagagtatggatcttagagaggtaacagcagaacacattttatcctgatactcaggacctttgtgggagaggggacaaggtaacctgtcagaaaacatttactgtgcaggtagctggagcagagccgagagacaggaggaggaggaggtggaggaggttcagaccctgactttgggaattcactgtcaagttggggagttagacatgtattattaatacaaaggaaaatctaagttttatacaggacagcagaggagattcctaaatacatttatatagtgctttgggatttataaactgcatataactttgtaatatgattaagtgctaaactgaacaaaagtcatattgtaggtggttctaagaagggagatccataagggggtgctcaaagcagattagtatcgaggaaagagtgggcctgaagtccagagaccaatttttagctgtatgaccttgagtaagtcaattctcccctctgggattcagtttccttatcagtaatggagagatgataacacatgttataaaaggaaacagcttcccttcctaaaacaacacataaagctcactattcctctggattttaccatcttcacagggtgtcttactctaaatctgctatgattaacctcttaggccaatggtagatataagccccttttctctattctcattagcatggcggagacagatctgattcctagggcatactgctttccttttaaaactcaggcaggacctacaccctttcttttgaaagaggtgacaaacttagtggcttaaattgtaatctctggagccagattacttgggttcaaatcctggctctgccatctgctgctgtgtaaacttgaacaaattacttaagctctctcgcttgtttctccatctgtaagataaggataataattatacctatgttatcgggttttgtcaatatatgtaaggtgtttggcacatagtaactactcaataaatgttagctgttttttccttccccttaatgcaacagacagattggcatttctaaaacagagaccagaaaagaaataacaaactcttgtaattcttaataccagagaccttcaggccaaaggctactggatttttgtttcttggaggtgaaaataaccagtttccaaaataccaaagagcataaaaataggcttaaaaagtccaggttgttggtctgagaattgcagtcaaagctgcaaaaatctttctgacaatgggccccatatttaaaaattaaaaaatagttttcaaaagagctgcaaaaatcctggcagggctccaaacccctttatccttaaacaatcttccagggagatcctggcagggtttgcagggaccctcctcaaccatatcgtctatgagctccctcatattcctctcccgtacatggcagctgccctccttgagactatcctggtccaaggacaaaggccaactcctcaattcttattttagaaaattcagaccttttcctggtgcagagcctggggcctcataggcacacacctaattcacaatcaaaggttgctttgctaattgagttcactctgcttcctggtgctagttatcagttccacacctggagtactctgacccctccacctctatatacacacccacccacaaaagaaataataagattataagagtgccctcattgcagagccacagttgtaactatgccttgtccttacatgtacttagtgcctgttctgtggcagttcacagtgctgtagaccagcaccatttgtccaaagcagtattgatacttctggttgaataccttagtgcccccatctcaagtgatcatttggcaggaaaaaaagtacccatgtgacaatgtatgtgtagatgcatatggatagaccaaatcaggtgtgttcttatgttttctaaccgtaggcagctttctctctcttcttcctttttctaggcttgtcgtttttatgatgttgataatccagaaatttcaaattctctaccataaggggcaggtggtacagaaagaacggagtggttagagagtcattttctaatttatcaagctatatatctaacactccagaagtttttttaaccaaatatgcacacaacaaattagcatatatccttataatgggagaatggcatttatcttacaccatcatgtctacctgccagccagggccattgaacatacaagaatctaattaatatgaaaggactttgtgacagctaaagcaaaccccaaacagttcctatcatcacactcttaagtttttgtgggttttttttgttgtttttgtttttgtttttgttttttgagatggagtctcactctgtcgctcaggctgaagtacagtggtacgatctcggcttactgcaacttctgcttcctggtttcaagtgattctcctgcctcaccctcccaagtagctgggattacaggtgtctaccaccacgcctggctactttttgtatttttagtagagatgaggtttcaccatgttggccaggctggtcttgaactcactcctcacctcaggtgatctgcccactttggcctcccaaagtgctgggattacaggcgtgagccaccgcgcccagccccacactcttaagtttaactcccagtagtcactgaactaacctctgtctctcctgacattcatcagtcttcctcatctcaccccaacctctacccttggggcaatccaaggcttgatgtttactagataatacttttttcttttggtgtttaccacatcctgtgagtctgttaaggcaagaatgactgtcctcatttgtaaaaggagagacttaaggtaaagtgatttgcccaaggtcatatagctaggaagtggcagaactggtattgaagtacactgaagattttggacaaattcaagggatctaacttcattcagcagatggtagactcaaaattggtgttcaaagaggtgatatagacagaaaagtaaaacagtttcaaaggagaatttagagaagtttcaggatgacagatccagaagtaattatcaaaggcatagggggacatccttctactgggagaagtccaccttggtccttcttcaccaacttgaagcaaagcttcctgctgaatggaacctgtcccctcaagcaaaagtctctatgggaaaccctattggtaccagtggtgtaaaggcaggagcagagctagggtaggaaacacgcagatgtggattgggtctggacatgtaggcaaaagtgcttggaccaagatctgttgacttattttactactaacagggtcaggtgcccacctcacctgtaagctctgactaattttgcatttctgaattgtgtggtgtccgcatccctgctaatgagcctagtcccataagtacatatgtatgtatgtagacctgtgtgtgcatagtcattcatccaacaaaaattgactgagtgccaggcactttgctaggtgttgggagatatggcaggggtcgggaggaaagacatttcacctccttcatagatgtcgctatctagatggggagacagtaatcaagtagacaactaaacaaaataacaggaaatatgtactgtgtgggaaagaaacatggtgttgtgatcaataataatagcagggttgggggtagcaatctatcagatactgttcaggtaaaggctttccaagaaggtgacatttcagctcagaattgaaggatgggaagggaccagccaagggttcctcctcagcctgaggccaggtgagaggagttctggggtagagatgggggtaggatggcagggtggttggagtactcagtaagcttgggttctgctcctgttctttctgttccattccatccttgaagggccttctctcccttcctgtactcctacctgcctgtcccacctcattccctccaggggcaaggtacgggtgtatcttgtccccatcttgagctgttcacagttcttccctgcccatccctgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaaggcaagtgtgtgtgtgtgtgtgtgtgtgtgtgtgtgtgtgtgtgtgtgtattatgtaggggtaagaagtaagtttctgaggaaacaagtaatgaaattatttttttcctacaaccctgagttttggaaatgtagcattgtcttttctaaatcaaattaagacataaatcctcaatctataggtggtgaggcccagggtgagacagttcaggtggagggttttcatacagctgacatggatgttctttccctatgcacccatggtttggttgaaggagagctattctgttaactcaaggccaagggtgggcacagagatccctctcaggcttctaagaccataactcttagagttcaattccttccacctggcacactattaacatgtagtcctctgccagcacacaccatgggagccggaaacacttaagaaaactgtttcttccattgacttgaaagctatgtcactctaccttctgcccactccacccctaaattatctccatatgctttggaatatccctcaataagtctttagaaacacaattttggcctctctttcatagagatgggggtagggatggaataagcaaagggaattatcttttttttcccactcactctgatggtgtgtaattgagtgtgtgggcacaaatacacaacagagggactattatgagtgtgctatgagtgctcatgtgtgagtgatgtgggtggctctgaaataccatctgagggtgctggtatgaatgatggcctgatagacatatgtgtcatcaggagtgtgataaaggagatgagatgggagcatggagaaaaggagatggaagggagatggatgctgtgaaaagggtgctggcagggctggaatccctgaggaggatcttcctccagctctgcccagcctccatttggtggtcagtaggggtgggcataagaccctaacctgttccccattcttcccacagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttggtgagaagggagccacctggcctagctgggggatggacaagattatcctgggtgactacctcccaaggctgcttggtctagagggagggggacttatacaatcatctgttttctggagaaagagaagtcctgagggggttgcgtatcctgactaggatggtatcttggcttgtctggccagggagtgaagatatggttggtcagaaagggcaaaatactgaacctgagggaatggtagggggatgaatagaaggactattaggaaagactgggaatgaccagccttcatgggtcagtttgaggggattcccacatatccggacgtgaaccgcctgtggagcattgtggacaaatacaaggtgaccaagttctacacagcacccacagccatccgtctgctcatgaagtttggagatgagcctgtcaccaagtgagacctcttcccagttgctgccctgtgggtatccctcagagctgggtgctggcctttgtacagtctcttcttttccattgtcccaactctctgacctggaatagaggatggggcaagagaaaagcctgggtatgtgtgtcttccagtagtactcagagccttcctctctcccattcccctgccccaggcatagccgggcatccttgcaggtgttaggcacagtgggtgaacccatcaaccctgaggcctggctatggtaccaccgggtggtaggtgcccagcgctgccccatcgtggacaccttctggcaaacagagacagtgagtgaagggtacagaaggctggggcccagggacaatgtgggaagattgactcaaatttctcatctctgacttccccagggtggccacatgttgactccccttcctggtgccacacccatgaaacccggttctgctgtgagtgatgcttccctggctggtcttgggctaggcagggatggtgtcttggggcacttggcctagttagatagtggagaactggactgacatgtgtgaagaatttggggttctggggccccttgggagttgagtcagagttgcctcattcctcttcttgggttctgtctcccgtttgcttctagactttcccattctttggtgtagctcctgcaatcctgaatgagtccggggaagagttggaaggtgaagctgaaggttatctggtgaggccctggcccttgggagtctttaaggagagagggaaagggtctgccaagggtactttgctttagagttaataacctaatctctcctggtagctgcttaggactgaaacttcatggttggaggtttgctcactgagagaccctggaggggaccctcgatactttgcctgcatctcttccttttgggccataagtctcctaagggcgttttaagagttgctcagattcctgatggtacctttttgggtctggaagactaagtcccatcttcttttgacaaagattctacagaaaggaggctttataacatagtagaaaatcacgtaggatctggagtcaccctgcctgggttcgaatcctagctctgcctcttctgtgacctcagataagttatttaacacctctgaatctacattttctaatttgtaaaatagggttaaagtggtgtctctggccgggcacggtggctcacacctgtaatcctagcactttgggaggctgaggtgggcggatcacctgaggccaggagtgcaagaccagcctggccaacatggtgaaaccccgtctttaccaaaaatacaaaaagtaactgggcgtggtggtggacgtctgtaatcccagctacacgggaggctgagacaggagaatcacttgaaccggggaggtggaggttgtattgagccgaaattgtgccattgcacttcatcctgggcaacaagagcaaaattccgtctcagaaaaaaataatgcctttgtctcctatggttgcttgcttgattgagttagataatccacatgaaggggttagcagagaaactaacaattagtacttgataaacattagctgttgtgattattgtattcatacttgcaggagcctcacctgtcccttcaaccccaccccatttcactttcccaagagcaagttagtaacagggacagggcttacatccaggccttctgactcagcctagaattccatccattccatcgatctgctgccaaagaatgttactgattgggcaataattatttacttggtgtgtgggcaccactgttttttaaatgagtgttttcatttgtatcaaactggacctgctttcctcaaggattgcccaaaaggagacacaaatttactaaacacttatcaataatagaacaccgtgctaggcaatttccatatactattaatttaatcctcacaataactttggaagacagaaagtattttctctgatttacagatgaggatcctgaagctcagaggggtaaagttacttctctgaggtcacctagctagtaagtggtagagctgggattccaagccaggatcctctgtctccaaagcctgtacttcattcaggacactttcccccacatttagaaaagctgtaattatcttccagtgagacagcatagcaaatgtgatcactgtcccttcctcactccccaggtgttcaagcagccctggccagggatcatgcgcacagtctatgggaaccacgaacgctttgagacaacctactttaagaagtttcctggatactatgttacaggagatggtgagccttagctatccccctcttgcacctcccactaagacatgtaccttccacttccattttcaggaagagttggtgtgttgctataaaataatacctgagactgggtgatttataaagaaaagaggtttattttggatcatcattcttcaggctgtgcaggaagcatggtgctggcatctgcctatggtgaggcctcaggtagcttccaatcacggcagaaagcaaagggaaagccagtgtttgacatggcaagagaggaagcaagggagagagggaggagataccagcctcttttaaacaaccagatcttacatgaactcatagagttactgcaagtacagcaccaagccattcatgagggatctgtcccccccgccccccccacctccccggccttgaccaaaacacctcccaccaggccccacctctaacactggggatcatatttcaacatgagatttggaagggacaaacatccaaactatatcagttggttaggggtaaagaaaattagagaagaatgtgtcctacatgtcagtatctggtttctacgcagagctacaaagactgtaagggcaggaatgagtatagcaggaggggtctcagaatggtgccatccgaactttgatgtatgaggaaagatggacaatgtatgctcctgtgttgaaagagatggggcatgtggcagtgcatgactattatgtcatgtttgtctttatgtctggagtctgtgtttctccatctatccatctaccaatccattcatccataagatctgagcactgtgatcctgtgcccaggcactgatcatgaataatgtagtcaaaatctcctccctcatggggattctagtaaggggagacagacaaacccaacaaacataaataagcttatcttagatagagataaatgctgttaagaaaaataaacagggtagcatgatagtgtgtgcagggatggctactgtacacaggatcgtcggagaagacttctctgaattgacatttgagcagaggcctgaagggtgagaaggaaacaggcatgggaaaatctagagtaagagtgttttgtgcagagggacacagcttgagatgtctgaagaatggactgaagcctgtgtggctggagcgtagcaagcaaagggaagaatattacatgacgttggagacgtacataatacagggagggtcttgtgggccatggtgaggagtttgaattttattcaaagtacagtgggaaaccttttttttgttgttgttgttgttgttgtttgttttttttttgagacagaatctcactctgtcacccaggctggagtgcggtggcacgacctcagctcactgcaacctccacctcccgggttcaagcaattctcctgcctcagcttctcaagtagctgggattacaggcgggtgccaccatgcctggctaatttttgtatttttagtagagacggggtttcaccatgttggccatgttggtctcgaactcctgatccacccaccttggcctcccaaagtgctgggattacaggcatgagccaccatgcctggccaccttttggggttttaagcaggggagtgctaagaattgatttactgtttagaaaataactttgctggatttatggagaatagagtttaggtgagtatactattggcatggaacaaattatcccaaaagttggcagcttaaaataacaaatattatctcacacagtttctgaggatcaggagtctgtgaacagtttcactgggtagttctcattctgggtctcttgtgagtttcagtcaagctgttggtagggcctgtagtcatctgaaggtttgagtgagcctggaggacctacgttcatgcttactcgcatggttgttagcaggaatcctcagttcctcacctcaccataggactactcaatacatggcagctagcttaccctacagcaaatgatctgagacaatgcaaccgagacaagctaggtgtcttctacaacctaatctcagaagtgacatcctatcacttctgccaaatcctatgatgacacagactaaccctagtacaatgagaaagaggactgcagggctatgaataccaagaggcagagatcagtggtgccctcttggaggctggctactacagtgggcaagagtggaagcaggaagacttgttagaaggctattgcagaaggtgtagcagtttggtaatgtggatcaggtatcctaccgtagggtttttatttattaggttttgcatttcttcccaggctgccagcgggaccaggatggctattactggatcactggcaggattgatgacatgctcaatgtatctggtgagggccaggggccaccttcccatcttattaactctgctcctctgacaacacccagccgaagccttccgcaagagcccaggagtgtcctttggccagaccatgtactaagtgtagcattcagttctgggcccaggttttagaggagtaatgaacactggaatgtgcctagagtaggggaacttggatggtggggtgactgaaagcatgtcatctgaggagtgaatgaagggtcttctccatttggccagaccaggactgccccatgggtacagatggagcatgggctggggcagagcctgggatctctctcatggcacttcctttcccttgacaaggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagagtaaggagcctccctgggcagggactatagggtctgtcttggaggcccagttatcactgcaagttgttggggaggggctagagcaagctgctccccaaaccacaaacagattccagggggccccatgggctgattgccctcttcctgttcagtctccactagtctcccactaggataataataatagccaacatttctagaatactttgtgccaccgctaggctaagtgctttaaatgaattaccccacttaatccctagagtcacctccatgaaacagatcttattgttaccttcatgctaaagatgatgaaactgagactcatggaagttaaatcacttgcccaaggccacactgctagaaaggtggcatttaaactctagcaggctcattctacagcctgagttccataagataaaatgagagagtaaagagacaagtgtgttgagagcaagagaagcagtgaacctgaggctgtctctgtgggcagggacttgaggaggaaacaggtggggaacaaagccatctctactttgatttttgaaaagtctggctaagggtgctgaagaaatgcttgatgatttgttggttacagttagagaaaagattggccccattgccacaccagactacatccagaatgcacctggcttgcctaaaacccgctcaggtatgttcagaggcctccatggattgggatgggctgaggcctggtggtggtggggtgtgcgtggatgaaagcctttggcagggctagggtgggtcagtgctttcaccaagtaactagaggtctgtggttccccagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaagtggtgacttgttttcttaggtatctgtgccctgaggctgtatattcattagtggctctgatttgtgtggcagatgggaagggaggggtatttcctaggactatccccaatatcttccttctagaacttttggtttgggcagagcgaaggaggcttcactgacagggcctttgacaagcccctgagctaagcaggaaagtgactgaagccagttcacaactgttatgtatgtcccatcttggttgccttccctcctgggctcctgccagggactctcattcctccctgtgatccagtaagagcattagtgggtggctaaggattgaaacttcagggttccacctgtagagactggtctagggggaccctgattacagaccagtcacttccctgctctaatacatcttaagtgggctaacgtagattacagctcccgcctcccctctatgcacgaagtaaggaatcatcactgaatcagcaatgcagttttatttaaggcagaattagggaaaggctatgcccctccactccccctcctcctaccactcagtcctatcccaagtcaggcactggaacctgctgaaaaggctgatgaggggctgacaggagtggggcagggttcatggacctttacctcagagcagcttaccctgagctatacccacatctcaaggatttgggggcgtctagatctcatctaagggagacacaacttttctggtcctcagatggaaagctgggggaaggtaccagtatttacccttccataaaaactttggaggtctttaggaggatacccctcaggagggctaggagaggaatgacaaatacagaggatagaaggtcccgtggcctggttgtgccctcacacagggtatgggttgtccaggactgccactcccgctgccacaccaccatctgcatgctcgatggctttggttcgaagtagatgccccacgtgcttgttcatcacgagtgtcttttcctgcctatagaaatggaggcaggggacacacatcacctggactcagccccaaacccaggaccttccctggacccagctgagcagtacctgggtaactgtctataccaagaaagtgctaggattttagagtctctatgcctctctggagtctccttctagtcctaggttgtcaaaccatgtgttctgagtcctcttggtgctatttggagtttccttcacggttgcaaaggacttctcatcagggcttcatctgataccctggtaaggtgggcaggtcttgggtccttggcctcatttaatagataaagaaacaggtaataaagctagtgattggcagagctggcaccgaagcccaggattcctgactctttccagtgttcccctctaggctggctcacttggctggcactcttgcaagcaggtagtggaaagagcttctcctgattggctcacctgacatagaccccaaagatgcccagctctgaaatgcactggaccactcgggcagggctgccaggccgtagcaggcaattctcaaaaggctcaggttcgatcttctccatgaggatgtaggaggccctctcctcactgtccttcagctgtttcagggcctgtaccatttcctccccatataggttgttacctgcaatgaaactggccagtcaccctggaccctctgcctacctcctccatcccatgccctcacttttggggccacatgggcaagtcagcagcctcagttcctggcacccgctcagtgaagccagggcatatctggcttctcaggagggaagctcactttgacaggagagcccttactcatgcagtgaacacatcttccactacactgttctgccctggttctcctcctacctacagctgttccttctcaagctccattgctggctccttctcttaaatgctggggtcccaggggaattggtcctccacgcttgctctctcccccatgtacattttcccaaggagatctctcctattcctgagtctccatctataccctaaaaattgttaacttccggccgggcatggtggctcacgcctgtaatcccagcactttgggaggccgaggcaggcagatcatgaggtcaagagattgagaccatcctggccaatatgatgaaaccccatctctactaaaaatacaaaaattagctgggtgtggtggcgcacacctgtagtcccagctactcaggaggctgaggcaggagaatcgcttgaacctgggaggcagtggttgcagtgagccaagatcatgccactgcactccagcctggtgacagagcgagaatccgtctcaaaaaaaaaaaaaaaattgttaacttccaaatatttaatgcaggctccctgcttagacatcatatgactggcccccaaacaaactcaacttgtccaagcagaacttattacttctgcctgaacctgcccctcctggaccttcctactcccaatcaggcaaaaggtacccctgagtcatatttaactcctcccttccactaccctctcactatctaggacatgtctctccagttggccccatagtcatagccctagcccaggcctctacgttgctcttctgaacaactgtatcagcctcttccacggtctttctgcttccagtgtctcccctcattccaggacatcttctacaatgcagaaactgtaagttttgcaagttcccaccactgctaaccacttgagtcctggatcaatgtgtcccttcctggcttaaaactccctaatggcttcccactgcccttaagataaaatccaatttctcagtatatattcaaggccctttataatcaggatgcaaaccatttttccagcctaaatccctgtcccctcccagctccccctccagcctcaccagtttctcattaacctccaaacatctcacactttcatggcccggtgccttggcttgaggttgtcccttttgtatggaacactcttcctcctttccacctgggaaattcctacccacctcttaagacaaagattaaaaaaatcctctcctctggagaggcagacatgacccctgacctcaaggagtttcaaactagaaaggaaaacagacatgtattctctccagtctcctaatatgaccctactctacttcccaacaatctacccacaggcacctcaggtaaaacttgtccaaacccttcaatgctggttaatcagattcccctgtgctcccggacttggtcacagggtcttaggggacactgtccaacatgtggcctgtgtcagttccaatagtttcccccatgcccgggactgtgcccagagtaagtgccaatgagcactggccacagcctgctagtccctctcattgaggagccctgcaaagggagatccacctacctccaccctctctctggggctttagcacaaaccggctaggggcagcaagggcctcggcgatggcctggtccccttcttcaccctggcaggaggcagaaagcagttatcaaaagtttaaaggctaaagaggcaagaagcttaggtccagctggttatgcagagcagcatcagaggaagagcaggagggagaacagccacaaattccttcaggcaggatgctactatctggatgacactcccaacaaaccccctgcagcagccgatgcaatgagaacaggcctttctttagcaacagctcagggctctgcagcaggcagcctgatacacttctcaattcttgccacctgccttagtcccttccctctggttgccatcctcatctctacctttgctgagggagcttacaatggattccagcccccatccttccattatgaggctgcccttctgctcagagttctaggggttctccagagcatcaccaaccttgccagctccaccttccccttgtcacaatgccagctccaccctccccaacacattgggctgtaggtctctgccacctaggaggcctgtggtaggagaaacaggctgcccacgtaccacatccagtgagtagaggccagcaaaggtggcgcggaggcgggccacagcctcaggctggccagggagcaacatctccagcatgcccggcctgcttagctcctgctgcaccttcttagtcccagccagctgggtggcaatgtctgggcacttggcagcatgtgacctctccagcagtagacgtgcttcccaattctgcagagggaagaagacaaaaggaattcgactttattttacttcagctgacgtttactgaacatccatccattaggtgccaggtatcatgatttgtatcttcaccctcattatcacccaggatcattctaacatccttgtgagccaggtgtgatatgttgtagttatgtatcattgtgccagactgtgagcccctgcaaaggcaagaatcccccaatctgtgggaaacaatagaaggtgtaagggtagaacatttgtctacgtgctcagcttcccactgtgttccatactccctaccatggccttcaagatccttcaggagctggctcctgtctactttttcaaccttgtaccatccctgactcctagtctctgccattctactcacacaggcctgtcattcctcaaatcacaaagctctttccctcctcagggcctgcactgcttttccctcaacctgaaacccccttcctttcggcttttcccatgcatagctggatccttaccatccttacatctcagctcaatgtcaccttttcagagaaggcttccctgtccactctatttaatgtggatttcccataattctctttttacccagttgtttcattgaaagcagttacctgagactaaaacacacacatgcacacatacacgcacacgcacacaaacatacacacacaaatcccaatttttttttcctatttttgtttactttttttttcttttgagacgtgggtcttgctctgtcacccagactggagtgcaacagcgcaatcttggctcactgcaacttctacctcctgggctcaagtgatcctccctcctcagcctcccaagtagctgggactacaggtgcacgccaccacacccagctaatttttgtattatttgtagagatggggttttgccatgttgcccaggctggtcttgaactcctgagctcatgcaatccacctacctaggcctcccaaagtgctgggattacaggtacgagccacagtaaatggccatatttttgtttactttctgatgcccatttctctgaccagactgtgagctccatagcacagggctcttatcattttcctcattttctgttgtatctccagtgtctaacacagttcctggcactttgtagttgctcaataaatatttgttgttgttgctgaataagttgaaatttgagtggggttctgaaggacaggtagagcctgacaagtgagactcaatagggaagggatactcaggctaagagaataatatgaacacaggtctcaagtggatgatcacaggatgaatggtttattaccacaagagctgagggtataaaaggcaaggaaacagcaggggatcatgcctcccaactctggttcccattctcatgcaatggggagacagtctgtccttggctccagaccactgcaaactgcacacagcaggatcaggtctctcctgtgacccccacccaatgctgtccttcctttgatactactggtccacctgtagcaccttgacctgatcttcatcaataaccccaggaacccaactactagtctggcattccacgcagaatcacacgtgaccagaacatcagaaataaacccagagaaataccccattatggtagaagcaggaaagcaaaaccaaagataagcaaggacttgcccagggtcatctagtaagtcactaagccttctagatctctctccatgtctaaacctgctctgagctgctcagttccctaaaaatgtctacctcttggccaggtgtggtggctaacacctgtaatcccagcactttgggaggccaaggtgggtggatcgtaaggtcaggagttcgagaccagcctggccaacatggtgaaaccctgtctctattaaaaatacaaaaattagctgggtgtggtggtgggtgcctgtaatcccagctactcaggaggccgaggcaggagaatcgcttgaaactggaagtcaaaggttgcagtgagccgagatcgcaccactgtactccagcctggtcaacaagagcaaaactctgtctcaaaaaaaaaaaaaagtctacctctttaaacactactttccttccttgttatctcaaactcttctaagttttctttgtcgtgttttgaaatctagacccatttcttttttttttttttgagacagagtctcgctctgtcagccaggctggagtgcagtggcatgatctcaacttactgcaacctctgcctcccgggctcaagcaattctcctgcctcagcgtcctgagtagctgggattacaggggtatgccaccacgcccggctaatttttgtatttttagtagagacggggtttcaccatgttggccaggctggtcttgaactcctgacctcaggtaatccacctgccttggcctcccaaagtgctgggattataggcgtgaaccaccgtgcccggcctagacctatttttctaatagacagtttatctctcctgtagtcagcaagttgccaccactgctaaccacctatctaaagaaaaggatgttctatcgagataccacctctatagagcctcctcatgtggagctcaaccctcggggggagtcctagatgaattacagacctagaaggagccccctcagttttctagtgtagctccccccgctcatagaaacagacctagaaagggtcaggaacttgcccatcatcacacagaggcagtcaagctcatgacctccagctcactgcccatggtatttctaaacttatttcctcctttatcatctcccagctgagagcagagcttcttagcctctccatgatgtggatgttaggagcagaggagaagaatgggaataccatcggcctgaaagtcagaaaacctgggaacttcctgtagggccttagagaagcctctccatctctctaaacgttagtttctccatctgtataatggggataattatatgcctcaccgagtggttgtgagggttaaatgaaataatggatgtggaaactaatgaaactacatggtaggatagcaaaatgaggtgatataactgtcattaacatgaatgaggagatgataaaactttctgattcagataaaggaaaggtaagagttggcaggaaaaaaaatggtcagcagtatgctggaactggcttatatcaaccagtgagagctgattgttgttaaacatttgccagcacatctctggaaacagtgtaaatggctgaagctctgtggattcctgaggattcaaattctagaagactgtgtagagtgataggtagcaaaaggcttgagggaggataggaggttctagcagcaagctccctgagaaagaagtgaagtgaggactcggaaaacccaggttgttataagcctgaattgggtctctgtggagctcttgtgggtcccaggaggcaaagaatggtctcacagaaaataccaacctgtagactgtactgacgaggcatgtagccatcccggaagtaaaccacagcaatttcctggccatccctggaacacaggatggagaaggctgctgtgttaaattataactgatttgttcagtggttcaatctatttcagggtgcatcaagatgaatttggctttttcaaaattcagcccacagtgggagcctggtcaggggttcactggaaccagtgaaagtagatatccacactaccagggcttccactgaaaacagggaggtgtgccatacagaatactttagaatatgccagatttagagtcattctaagaaggccagaaggaacaagaaggtcactagaatcaaatttggtaaatgcatacaaatgttggctcgaaattaccgagcagcagaatcatactgccatgtgtagtaaaacacactttatatttccactgcttaaagcagctgaaaccagaatgaaaaaatttttaatggcaggggtgaaggtgaaaacgcaaacatgtaaaatgatgagtctgattaagacacaggctttttaaatgtcttttccttttctttgacctatttgatattgtctagtttatctgaaaagtaaattaactactttgtttagttatgataaaagcacattttgaaaaacagtgagtggtattgtgaaattccatggacagttttaattttaacaatcacaaaggtctaggtctaaatatatgtgctgcaatgctacccaaatatgtagcaccaaatctacctggtggtggcccctagagaaaaggataaggcttggcttggaacacaaatccaggctcgagctcagacagtggcatccagaccaatcacagcatgagccagctgctcctcttcctccctgactgcccagctcagcttctcaggcctgacctcaccttactaggagaggcaagaaaacttttgggaacttagggcatatgaaaactaagatgatctctaaggagaccctgatccagaatgtcaacagctctgatagaagcacagcgtggctggctttctccaaaatttcctgggaggatgagatatttcaggaattatgagagaaggaagcaagccatcacatctcccagaagaaagaatcattttggggaagagggtggcaggatgagtttcataaaccagccttccactggattcttgggaatgcttacacaaacagccttcggtcttggtccagagaccccttttcagagatatcttcaaatgttcgtcggatcacatggatgttcctgggaaaaatgggcaagagccagagggaatggatgctatgttctgagtgccccacccctaatcctggagccacacctagaagtcccccttcctttacttacctggccagtagctcattctctatggcacgctggtcaaatatgtttctttccttctcttgagcaatcagtagcaccagagcactggggaaagagcacaggtggcccgaggctactatagaacttgttcttcttttgtttctcccctcaacccccataccgccccacctcctggaataagaataagaacaccgcttccctgaaagaacagatgttccctctctcaggaaccttgagattacctcaggcatagacacctgatgctatcacatatgatttcctgaaaatagaaaacttcaaaaatgaagatgcctctgacccttctccagtgggcagatgaaatattgtaatgatgtcatgggttgatgaatttctgtgcaaattaaaatttagatttaaaaccatctcaaaaacccaagaggactttttcttagaacttaacataattctaaaatctttctggaagaataaacaagtgggagtattgaggaacattttgtaaaagaacaatgcagggggtccggggctaatggctctattactagattgtaaaggatacaataaaggaatgtggttcttacacaagatggaaccctacagaaacccacagggccaactacaaacaacgacattatctcctgggccctcccaagattcctataatgtacacagggccacatttgatctcatagtattaatgagatcactagggcttatgtggcttcttcctctctgattattcatgtatttcttaaagaggcaggggcttgagggctcagggaaaagcttatgccagggaactatctgtttggctgccagctaacatatttccgttgtcaaagataggtccagtcccctaagagattcctagggctaatgctcagcagtaccaaactgcattttttttcttttacattttattttatttatttttttgagacggagtctccccctgttgcccaggctggagtgcagtggcacaatctaggctcactgcaacctccaccccctgggttccagcgattctcctgcttcagcctcccgggtagctgggatttcaggtgtgcaccacccccgccggctaatttttgtagtttgagtagagatggggtttcaccatgttggccaggctgggctcgaactcctgacctcaggtgatctgcccgcctcggcctcccaaagtgttagcattacaggtgtgagccactgcgctcagcctccaaactccatttttgctgtgactgtactgctttgtgtctgtggcttcttcctgagacccatggaaccctaggctttggcttaggattctaagtgtgtattccctgacctcctctgcttagcctctcttgtctatctctgcttctcctgaccttggctgaacctcttagtctaaactctgtttgcctgactcctttctgcttagccaaaatataggtcttagtaagtcccctctcctggtttgcctgaaatctcatgaggtcagatgtgatgttaagctgagtcttggctttgagttgggtgcctgagagacaaactaaaagtggtgctctcacaagtcatcttgccctgagagagtcctaagggccaatggctttgctcttcactttgcagcctaaactgtcccgctcatgggtgagggtgtgtgtgggagggaggcagttggcccaggctggcccacctccaaaaagaggcggaggaggaaggctggcagctggaggttaaagaggaactgcacgccccagctaattaagtcagcctgccaactgctaaacaatcagagctgggctcagaaaacatatttgacctctcctgccttcagttctgagcagttctcagcagtctgtttcctagtaggaaagttgtcagctaaggacgcatgcgggctgggggtgaggacccctgagtcgtaggtagtccaggctctgccagtgacttgtagtgtgtcttggtaattgacttgggtaaggcaatttcgttccttgggccctggttttcccatctataaaataagagtgttatggctgggcatggtagctcacgcctatagtcccagcactttaagaggccgaggcgggcggattgcctgaggtcgggagtttgagaccagcctgaccaacatggagaaaccccgtttctactaaaaatacaaaattagccaggcgtggtggtgggcacctgtaatcccagttacttgggaggctaaggcaggaaaatcccttgaacctggaaggtggaggatgtagtgagccgagatcgtgccattgcactccagcctgggcaacaaaaacgaaactctgtctcaaaaaaaaagaaaaaaattggtgttaaaaagatcacagttcccaaacttttatcaccagtagtccccttttcttattctactcattctaaccacaggccctatgctttgagagtttgtctaaattgaaattgtaagtcattttgcaggcttccatttttaagaaattttaaaaatcatgagataattgacgaaaattaatctgctctaccaatgcagtttttcagtcaatactgtggaaccatatctcttaaaggcagaatagggaagtagagagaacataggctttagaggcagatgaattctatacttaccggttgtgtaactttgggcaagttattcaaactctcttagcctcagtttgctgttgtatgaattaaaactaatacttgtcaaatgatagctattattattattatttgggtttgttttttgttttttttttttttgagatggagtctcgctctgtcgcccaggctggagtgcagtggggtgatcttggccactgcaacttccacctcccgggttcaagtgattctcctgcctcagcatcccaagtagctgggactacaggtgcctgccaccatgcctggctaatttttgtattttttagtagagacaaggtttcaccatgttggccaggctggccttgaactcctgacctctgatgatccacccgcctcggtctcccaaagtgctgggattagaggtgtgagccactgcacccggcctattattattattgaaagtaccacataatgatccacacagatttttaaaaacatttttcagatccatgatctcatttaattctcactaacacccctttaggtattattattactcctattttacaaatgaggaaactgaagctcagagaagaactaacttgccaaggtcatgtgctatgtcagcagaagaacctatctcactctcacaatgggggaagccagttctggctcaggtgccacataactcctacctaccagtgcctaattttggacacacaagtattttctgtccacgttactgacaggctggcaggcaaaaccctctgcagcatttgtctgtcagcagttccccagctgacccatcccctggcttcactctcttaaaatacaacctagccaatatacttgaaagaatatttgtctgatgacttctaaatgcttacagtctgaggtttctttgggcttagtgaggcttagcaaggacagagaggctcccttggaggtaagagcatgattaagagtggaggttttagagggaggtagactttgggatctgccaccaactcatcacttagccttaacaattcacttcgtttctcagaacctcagtttcctcatctgtaaaatgagggagttgaacagtattgacctcagagagcttattatgagaattcaatgagatcctgtatgtacagagcttagcacaaggtgtagcactagtaagtgtacattaaggactattaatgctatattaacattgcaataactgttagtatagcggcccctcgatgatctgaaaatcacttacctaacatcttcacttgagaaataggaagaaagcaaaaaatgcctctaagcagttaaaaaggataccataaaatttcgtagtcaaagcttatgcatttactcatccaagaggccctcacactcttcagacccaatcataacaatctggatcatttgttttcccaaaccacagcaaatcagaagggaggcatgggcatggggggtggaggattccaaattcaagcataccaacagcagtcaaaagtaagagctgagaattgggaaacagacaagaaaactatgaagaaaatgaatgagaggccgggtgcagtggctcatgcctgtaatcccagcactttgggaggccaaggtgggcggatcacgaggtcaggagttcgagaccagcatgaccaacatggtgaaaccccgtctctactaaaaatacaaaaattagccaggtgtggcagcatgcgcctgaaatcccagctactcaggaggctgaggcagaagaattgcttgaacccgggaggtggaggttgaagtaagccaagattgtaccactgcactccagcctgggtgagagagtgagactctgtctcaaaaaaaaaaaaaaaaggaaatgactaagaacttaaagcctagcagtcagagctattagcgcaggcaaacagccttgcgtgcctctctaaccctaggtagcactactgtattacagcaagctgcaattgttgacagtcataatgatgacctccactcaataagaaaaagttaaatcatagtcagcatctgttatttaagaaggaaaccttaaaataattttggcatgtaaaggtataagtttctattcctagaaaaatccccttattctctaatgatggctggcaagaaaagaagttgctaaacccatgaatgctgaaactaaagcaggatcctcctgctaccttttcacacccttacttgggtgagccgtagagctcccaggctttggcaattcccagggccagtcccttgctgggattattagagaggatcttgccagcttctttggtcttactcaggacactgagaacatgtctgttggaagagagatggctgttcagtaattggatggacctggaagacccctctgcccatgacctcatatatacagcaacatgactctgagaatcagctgagcactaaaaagcatcctcccatcacattcctgtaagatccacttcaggttggaatatgctgggctgccctaaccttggcccctggtgtatatgcctggaggagacctgagagcctctgtccccaccccaacctaccctagtgtcccagtgagctggagccccttactctgggcctccaggtgctgtctggaatcctgctgcagaccatctaaaatcattgcaacctggagcatcactgctggctagaaatggatgctaccaggcccagcccccagacagaagtccctgcattcctctctctggggctctcaagatattgttccctctgcctgtacaatggagggacaggactagatgagctatgaggtcctttttctccctgacataccaaggatctcattacaagtggaaactgctgtcggggtggccaggggcaacatgtgacccggggcccaggaaagcacaatcatagctggagttccctggcctagccagtgactgtacacccatcagcatgtcaccccacaggtatgccgggggctgcccaggggacccaccggtgcacagctggggtccgggaggccaggcccccaaagctggcagagatggtgttgatttcgatctgtttcagggctggggagccatctgcgctgcgctggaacatgtagtctgagcgattcaggcccaggaacacagtctgtggggaaaactgaaggctgacagtacctgcccagggactgactctgaggacctagccacagagcacacaggtaccatgaactctacacagagattagaggtaccagcaaacactcccaagcccagtggaatcattcttctggtcatcctagaattggtcactgggataaacccagtgaggaccagtgagaggcagattcccatgagctgagggcctggaccaaattcttcaagcaaaacagaaaacaaacagagatgggagggacaggttacagactggagtagggctgggaatggttacctgggcaatgccctcttttaggacttgcttgtggatgtcaaagagacgagcggtaaagtcatcctgtttgatggtgctggaggaagaaacagagaacattttgcaggcttaattggacctaaaatttcaaggagtcccatcctcagtcattgactcctgaatcctctctgagtctactggccaaaacttgaatgtccgccccaatgtggtagagaacagtggctaagaatccaactctagacctgggttcaaatcctagctctaccactcactagtaggcaacctcagggaatcatttcacctctctgtgtctcagtttgctgatctttaaaatggagaatataattatatttatatcatagagttgtggtaaaaagccaataagatattacattcaaagaattgaacatactgcaccgaagaagagctagaaaatgacatgatgtatctattctacttgaatagctctgatggttggcaagccttctggttgacctaatactaactctccatagcttttcctaccctctgcgacctcccagggtgagccttctcctcctcctccacagcagcccttggagattagaagacagcagttatgccctgtgcaccaataagatttttctgacccaagctaaatatcctgggttttttttgtttgtttgtttcttcttcaactagtcctcatatgatgtgatttcctcagggaagccttccctatctgagtcagatccccctactatgtgttctcatagaactaagaaccactcctttacagcactgactgcagttgcaattttacattttctttgtgtgatgattagtgtcatctctcctgtttgactataaacctcatgaaggtaatggctgtgtctatgcaggctcatcgtcacagctcagtgtactgccatgacatgtgacatgtgttaggggcctatccagtatggttttctgaagtctcaacaagagccacagtaagaaggaatccacaggtgattaacatcacacttactgccctttgagattcagggtggattctgcacacctgctcaagcctgaatcaccttgttacagaaacgtcacagcagaccagtggggggaagccaagtagcccaggcctgccctgaagttcctctgctcctcagccagctctctcccaagggtgagctctctcatgccagcccttggttaggaggagagtcccagctgggcttcagcctccaaggaagttgagacacactttcctttttctgaagaggtgctccccttcatgttttgtagggggctcttctcccttaggaactagggtttatatgtgtatgagaggagagaggaacagagaaggcaggggttgcaaagatgagctgcaagtctccttcataattgcatcattagggttataagccaggctgctcatgtttcccacaatccaggattgcaggtacaaagctgggcccattccaagaaacagctcaggggcaaggtggtgggcagattcatacattcatgactcattgggtttttggctacaagtcaatggtttccaagcttcttaccattatgaccccttctcatattcacccacacatttttaaaagattttgtctccaacaaaagtctaatttctgttgaaaaattaatcaaagacatgcaattacaggttggatatcccttatccgaaatgcttgggaccagaagtctttcggattttggaagatttgcatatacgtaatgagacatcttggggatgggactcaagtctaaacacaaaattcatttgtttcatatacaccttatactcatagcctgaagattattttatacaatattttaattaattttgtgcatgaaacaaacttttgactgtgttttgactgcacctgtcacatgacatcaggcgtggcgttttccactggtagagtcatgtggtgttcaacaagttttgaattttggagcatttcagcttttggatttttggattagggatgctcaacctgtacagtatatacacatctagcatgtatatgtaaatacataatatttctagatatttaattctacaatgaatatatatacatatatatatgtattattatttctttttttttgagatggagtctcgctctgtcgcccaggctggagtacagtgtcgtgatcttggcttactgcagcctctgcctcctgggttcaagcgattctcctgcctcagcctcccaagtagctgggattataggcacccgccaccacacccagctaatttttttatatttttagtagagacggggtttcaccatgttggccaggctggtctcaaactcctgaccttaagtgatccacccacctcggcctcccaaagtgctgggattacaggcctgagccaccgcgcccagcctatatatatttaattctaaaataaataaagaaattttaagaaattgccccagaatctgaagaaaaaaaaaaaaagatcaagggaaagagacagagaagggcggatgggctgaaccatttcagaggttgcttcctcatgccctgagtgtggcccagtctgtaccccatcccatccaaagatgagaggcctgaggtgacaagaaagtgtcgctgcttaggagaagtagaaaatctgactttaacccaataaccttccctacctctgttttcctccaaaaccaggctgacttcccctaattccaaatggaaatatcagtcttcaaagtagggtgtcacggattacagaatgtcaacaataaagggatcttggatttaagccagtctcttcatttttcagatgaagaaaccttaggcccagagaaggaaagggagtggcttgaggccatataaataactggtcgagccaggattagaagccagctttcctgactcctatgactttttgttctttggaggtacctttcctctatcccaccaagtcagctgacacagtaacacctcacggctctgcaatcttccagttccttggctctggcagctcctggccccccaatgcttcactgtcccctacctggaaagagtttgctccaggaaggcagcgttctggctgacagcatccactagcaggttgaagtccatctgcacagcataggcttgctccagcagggcactggggaccagtgaggggaagagcgtgaatggggcatagctcaccacctgtgatcaagaagagagaatgggacaggggtagggcacctgtgaacgggttgtcttcctgcaaatggaatcccatggaaagtctggcctatatttactgaggacacaccaactgtagattagtggttaccttgggagagtggaagggggagagtggaacccagagagcttccagattctgtgatagtttatctctacgtattgaagagagagaagcaaaaaagcaaaatgcaaataacaaaaagaaacccacaagttattgagcacttactatgtgcaaggtactattttaaatactttacatagattcatcattcagccctgtgaggaagatactattattatccacacttaacagagacgggacctgagaaagagaggttaacagatccaaaattatattcagctaggaactggtgctgggatttgaaccagaacagttaacagatccaaaattatattcagctagtaacggggtgctgggatttgaaccaggatggttactaaacacaacacacacatacatacatggaagcctgctccttgctggttgatgttcaagcccaggcccttccatgcatcaggagctcacactccagtttccttgccttttgattttgatttggttactgggtaggacaagtgaactctggttcccttagtagaagccaggagtgttttttccaccaatgttagtgatggtgactcaggttaacaggcctagagttcagctgcattccgcattctttggactttatcatagacgagaaacccaaataccatcaaggacactgattctagaagggaaaagtgcattctgagatccctgccaacaactgaactagaacttgggtaagagatgaaaagaaaatcttgtgacttgtattataaagcattcctgagtttaacctttgagttaatatcagtttgtcattatggtggtataagtttacggtgttagaacttggtatttagatatttatttttaaagtactatttttttttttgaggtagagtctcactctgttgcccaggctggagtgcagtggtacaatctcggctcactgcaacctccatctcctgggttcaagcaattctcctgcctcagcctcccaagtagctgagactacaggtgtgtgccaccacacccaggtaatttttgtatttttagtagagatggggtttcactgtgttgtccaggctggtctcaaacacctggcctcaagtgatctgcctgcctcagcctcccaaagtgttgggattacaggcatgagccaccatgcccagccaaaatattattatttttttaacaggtaatacaaatacatgatacaaaattcaaaagagacataagaatatatagtgagaagtatgtctcactctcattccagtctcctggggaaaagactgggccccagccacccagttctcctccccagaggcaaatgacagactagtgtctcacacatccttccagtcatctttgtattgatatatatgtatacacatatattttctctttttttcacccccatagcaaactatactacattgtgctttttaaatatttccttatatgttcaaatagagcattttcattatttttaattgctgtatattattctactcttaggatataccataatttattgaatctagtatataggtggtttctttattttcctattaccattaatgtttcaatgggtatcctagaatatacattctagatattttcatatatgagaaagtccatacattctaaatttctaaaagtaaaaatatcaagtaattcaggtaaatctattttaaattttggtagataatttctaaattacccttctcagcatcttttttttttttttttggagtggggtcttactatgttgcccagactggaatacagtggctattcataggtgccatcatagtgcactatagcctcaaattcctgggctcaagcaatcctcctgtctcagcctccccagtagctgagactgcaggtgtgtaccactgccctggcctcagcatctaagataaaactgaggaaggctatttgtgagaataaggtttattcagtctgaagcctttatgagttagaatgggaatgactgcagattacataaggggtgacctaataccctgagtagctatgtgatgactacaggagcatttccttggcttgaacacatagagctctgctgcccccaacaagtctcatcttggcctcaaaaactcagagtttttctgctaagacatccctctgcctctgtcccagggctcattatgccctcctgaatttaggatcaatagtttatagctgttctctgctatctacaggctaaaggctgaaacacacagtcttctcacttttgatagagacattaacataaaatgacattactggccgggcacggtggctcatgcctgtaatcccagcactttgggaggccgaggcgggcagatcacaagatcaagagatcgagaccatcctggccaacatggtgaaaccccatctctactaaaaatacaaaaattagctgggcgtggtggcacacacccgtagtcccagctgctctggaggctgaggcaggagaatcgcttgaacccaggaggcagaggttgcagtgagctgagatcgtgccactgcactccagcctggcgacagagtgagactctgtctcaaaaaaaaaaaaagaaacatttttctactatttaaaaaaacctatagcacgtgcatgacaaaattctgctttgtagccaggaagcaacagggagtgataggaattgtggcaaaaagaagtacttgcatcttctctaaagggggcagccagaactctgctctagccaattgttgccatgcaggaaagtaggccagagttgccagatgatataatttttcaagacaagttgggttgctagattttttgttttaatttcatgatttttttttttaaatgttggctctgactttttaaaaatactctggtgaaaacaactgttaacaatgcttgcccctggtcagggaaacagtggctggaggaaggggacttactctgtactgaatacccttttgaattttgcgccctgttcaaatgtatttgaacgtattacttattgtaaaaaacaaattaactccccaaacactgcaggagccaaatactcagcctagatatggctagtttgcagctctgatctacaggataaagttcatactcctcctccacccagtagctaaggccccgcggctgtctgacgctggcctgccttctttcccactatatccacttatgcgccctgcatttcagctgcattctcttgaacatttttttttttttttgccttttcctacttttgggtccttgctatgctgttccttttccctatttgtcttttaaggtctagttcaaataccaccccccatctcaatcatctaatcataatgaactactctttcttccagctgtcctatatagtatcttgggagaggaaaaaaagcatggatgttcagagcatggactcaggagccaaattccttgggttcacatcctggctctgccaattattttaccatttaaataacctcaggtaggttacttagcctctctgggcttcggtttccttatctctgttgtggtgaggagtcagtgattccaaagtgtttagaataatgcctggcacatactaaatactcaataaatgatagttaactttgtgtagcagactgcctgtgtttcctcatagagctgatgttatttaattttgttttgtggtatgttctctaactagaccaggagccccagaggctagggctctggctgactcacctctctgtcctcagtgcctacaatggcccggcatagagcaggcatttggtaaagatttggagtaaaatcattctctctctctctctctcacacacacacacacacacacatacacacacacgtacactttctgactttttttctggattagaaatctcattgtggattacgccttttctaggctccataacctcccagaaagaccaagtgttggatcttcacatggtacctattgattaacagaagaaacaaaagcgtggaagagaaaatgcttcattttagattcatacaagtaattcacaaaatctaggttcacagcccaagcaattctattccataccatcagcctgccttaggtgacagacattgtcatttacttgggccttagcaaacaattactgagtgtggactccatcaggcctgtgtaggttctgggcacacagagacaaaaaagaatgggtctggctaaaaaaagaagagatgttggcagctctttagtcaccaatatggtcttaaggtgtactgttaagttaaagaaaaaaaagtgggcaaaaggaggctgggcacggtggttcacacctgtaatcccagcaattttggggggcagaggccagtggatcacttgaagtcaggagtttgagaccagcctggacaacatggtgaaaccctgtccctaccaaaaaaaaaaaaaaaattagccaggcgtagtggcacatgcctgtagtcccagctacttgggaggctgaggtgggagaattgcttgaacccaggaggcggaggttgcagtgagccaagattgtgccactacactccagcctgggcaacagagcgaggccccaaggaatatatttacttgttattagttacttgttatgaataagccatctgaaaggatcaacaagaaaccaaaacacaagctgcattagggtaaactcttgtaccatttgaatttgaaccatgaaaatgtcttacctagtcaccaaattaaaaaagattttatttttttatttttttttcttccctaaggatgaggttttaaaaaggtgtggtttggactcagcagttctacttttacgtattgaacctggagaaacactcacataggtgccccaacagacatatgcatggatgttccctataatgctatttatggtcataaaataatgagaaatcacctaaatagacatgagtagagggaagctaaactgtgatacacccacatctggaatactatgcctcagaatgaagatgaccctaatagaaggcattagaaagttctaagacagacaaataaaaaaccaaaaacatatcatagaataatatatatgatacaatttgttttttaaaaaagacgtatttctatatatacctatctatgtatataaatgcacagagaaaggcttgaaagcatatatcacaaaccagttacagagaaggtagagtgattatggggttttcagtaatagctcactgggcaaagtgcttcacatgaatcatcctgtaattctcttaccaaaccagtgaggtaggtcctattattatcccatttttacacctgaagaaactgcagctgagagcggttaagtaatttgcctaagtcacacttcaaaccccatatttaaatttgattactccaggacactgcctttttattttctacttctagagatcaattttagttactggaaaaaataaggcaaaagagatatggtccctgatgcaaaggagtgaccctcagcctggccggggccagacagtgggccatggtgaatgctgtggggaggagctaggggcttacctccgaggaagtgggctcctgtgaggtcctcagcaatactccctcagccagggcccggtccacggcctgccgtgccagctcctctagctgctgtttatcctgcaagaggctcccccagttggtggccatcccaacacctgcaaaagatggagagaagagagttggtaacagatggcctgaagcccagcaaccaccgaaactggctggcggccacccccaacacagcaggaccctgacctctgttggaagggaacagcgtggtatacaggagtgaacactggctggttctagctcttaacaacttccatgtgcacaaaatagaaagcttgacaaagcatttccattgccactctctcttttgattcccaacacaatggcattattctcacagtaaggaagcagaggcttggagaggtgaaatgacttgcccgaggtgatgactggtatagcctggacttgaacccatgtctctggactcccagcctaaaggctcttcattggagaaagaagcactaatatcagatgtgactggggcaagttccttcccttcccagagctacagattccctaactgtgaaacaagaagaatcggatagatcagtttccaaacctggctgaacattctggggagctgggaaagaatacagattcctgggccccatcccagagactctgatgcaagaggcctgatgggaaggaggggttgaggctttgtatttttttttttttgatatggagtctcactcagtcgcctaggctggagttcagtggctcgatcttggctcactgcaacctccgcctcctgggttcaagtaattctcccgcctcagcctccctgagtagctgggattacaggcacacaccaccacgcctggctaattttttgtattttagtagagacggggtttcaccgtgttagccaggatgatcttgatcttctgaccttgtgatccacacgcctcgacctcccaaagtactgggattacaggcgtgagccatcacacccagccgaggctttgtatttttaacaagttttcctgggataggagtcactgcagtacattattaattcccttcaagctccaacaactcatgtcagcagatctcaaataaattacatgggaagggggagggagctctttgtggaataccatgaaatgcgaataaggtgaactcctcccttatacaaaccagaaggaatcttagtagcaggaaatgactacattccatatatggacatttatcatcaaagcaccaaaagacagaaaatatttttgagaaatcacattagcaagatggaaattgctgaaacccaagtgtccaatgtaataggagaagttgtctgattggttgcccagagacatacagaggtgtacaaactcacaccctgatactcattcatttttcagcaggcctcaggagtttaagatctgggtaaaaatctggaaacacagtcactaattttgttctgccctgttgccatttaacagaacatggttgcccaactcagtggtccccaggaagggagttagagaataataggaaacctccatcacattcagctctgtccccctgtccccatgacagagccagtgccaggccaattatgaaagtctgccagcctcagcacaatgctttgaaagaatgcgcatgtgatctcaagagggtcctgataatatccctgttgagtgagacatacatgagggcaatcatagtaaagaacaaggttcaagtcagacagacagacagacctgggtttgagtccataataatacgacttctccctttcccttctttccttccttccttttccctttccctttcccttccctccttctttccttccttccttccttctttttctttctttctctctctctccctccctctttctttctttttttttttttttgacggagtctggctctgtcgcccaggctggagtgcagccgcacgatctcggctcactgcaagctccgcctcctgggttcatgccattctcctgcctcagcctcccgagtagctgggactacaggcacctgccaccatgcccggctaattttttgtatttttagtagagacggggtttcaccgtgttagccaggatggtctcgatctcgtgatcccccactctcggcctcccaaagtgctgggattacaggcgtgagccaccccgcccagccgacttccctttcaagtaagattgctgtgtggattaaaagagaaaaatcagtgtgaaatttatcagcagtgtttgaagctctatacatgagaccattttttggctgtactctctttataggtaggaggagacttgtcagaggtcacacagaagcctagtggcagagccaggacaagaacccattaccttgacattagagtaatgaaaccctccatgagcccccatcgttccacaactctgaaattccaacatctgtttgctgttgggcttttatttagttggcaaacactgatttgcatttaatgccactcccttgactaggtactggggatatggaggaggataagacataaagataatcaccatgggccaggtgtggtggctcactcgtgtaatcccagcactttgtgaggccgaggcaggcggatcacccgaggtcgggagttcgagaccagcctcaccaacatggagaaaccccatctctactaaaaatacaaaattagccgggcctggtggcgcatgcctgtaatccgagctacttgggaggctgaggcaggagaatagcttgaacccaggaggtggaggttgtagtgagccgagatcgtgccattgcactccagcctgggcaacaagagcaaagctctgtcaaaaaaaaaaaaaaagaaaaaaagaaagaaagaaaagaaatcagatgaaggtgctaagtgggccctttgtttttctcattctacagcctcaaccctcccttggctttatttatgttttgctgatgacattcaaatctacatcttcacagcaatactttcctaccttcaaactagaatatccaattttttcctgcgagtctccatacaaccagaatagaatttgttgttgtctcccacaaatctgcttcttctctgatgaaccccacccaggtacccaagccttgagtacttgtttcctacatctcactctccccaaatcctatggattttgctgcctaagtatatagtactttgaattcctttatttatctccatttccagagtttgtagcctagccccggccactgtcatctcttccctgggcgtgaaacagattcagagtcaggtgtcttcagtgaccaggatatgttggcctctgtcccccttccaggacttggcacgtgctgtcttctctttggaactctcgccaccactcctgatctgggctcgcgatttcgttccggaagctgtccctgttctccgccccgggcttctacattctacagcccatcacttttccctgtaccgtaggaacagtgtttgtcttgatcacttctctacctagtaattagccgcgcttagtactgtattcattcatcacatgaatgaatgaagaatgaatgacagacgggtcagatcaccgaaagcctcaaaacgcccacaaggaaatcggtcgcactttatcgccaggacttaggccagtgcctggaaaggccccgaggcaacgacacggtcggctgcccaggctggccccacttcacgggcccgctcgcttccaccctggacaaagtttggccctaatcgctccccgttgtagctctaactggctccagtctcactggcctacatgccccgacaccggcccgatctaaaggcagaagatccggaaagtctgggatcagtgcgcgccagcccaaccccctcactagacactagttgccccgctcctacgaagggtttcagccacaaggtctcccggcctccggaattccaatctcttgccagacccctccctcacatcgttcctcccgaggaaacgtgacccatgccggccgccgtggccgccccaacctactagttcgcctttcctccgcgaacggttctcccggccctcgcgccgctacccaggctcagggggcggggcctcgatgcgacccagtgcgcttgcgctgaccgccccggctaggcttaaagagcaggcggggcagagacccatacctttggcgctgagtcgaggccaggaaggggcggtcgatgagagggcggccttagcattaggagtgcgtcggctgcaccctggcggatggaccttgggaaggaggggaggggaccatcggggtcggcggggagctacgggtatgcatagctcatagagcgtcagagctgacgacgactagtggaagatggggaaactaatgctcagagcgggacagtcactacctcaggggcacacaattgataagggtgggggtggccgtggtaatggaggccccaaggaggggcaggggcccatagtacgtcaggggctgagcctgtattagaacccaggcttgtttcccagcccagccaagtcccagaaaaatccccctgattttatctatttttttttaacctgggataccagcagggaaagcattagaggcaaaaggaaaggattttcatttttccaggaatgctgaagtcaggactgtttgaggggagccctgtgtttctcagactctcttgtaccgtttacatcaggatctggggcagtttttaaaaatatgcggattcatgattcctaccccccacctcattgcttggcagcccccaggtgccttccctgtttcttccttctgggttgtgataggcttgtctgcagtccgaagcacctgatacgaattttagttaaatggaatgtatcagtccagcttctagggaattaaccataaataagacacagccactgctttcagtctgataagataggcaataaactgcctttctgaaggaatcagggatggtttttggggtcttgaaggatggataggaaggtataggtagtgaaggaggtaggggtagaggtgagaggctgggatggggacagtgttccaaattgcaggaacaaaagcagcaaaggctggctgggtgcagtggctcagacctgtaatcccagcactttgagaggccgaggcaggtggattacttgagctcaggagttggagaccaggctgggcaacatggcgaaaccccgtctctactagaaatacaagaattagccgggtgtgttggcccgtgcctgtaatcccagctactcgggaggctgcggcgtgagaattcttgagccccggagacggaggctgctgtgagctgagatcacgctgcagcactcctgcctgggtgacagcgtgagaccctgtcctaaaaacaaaacaaacgagcagcgaaggcatataattctgagggttgctcggcttgttttacagacactgaggagtttggtgtggataatgaggaagggcctgagggttgcaacaggacttaggcgcttaggcttggagaggtagcctcagacgccagttccactgagcaacaggagctaagggctttaagcaggggaaggacatggttagttttgtgtgttaggcactggttacagcgtgacaaatggtttggaagtggggagatgggccagagaaagcagagagagttaagatgtgagatcatgaggctgtagccagtgcagcagctgtggagatggagcgaagcgaacagatcaaagaaatttaggagtgagaactcctagtgatcgtaaatcagtggcccaacccagggaccaagatccttttgactctttttttttttttttttttttgagacggagttttcgttgttgttgcccaggctggagtgcagtggcacgatctcagctcactgcaacctccacttcccaggttcaagcaattctcctgcctcagcctcccaagtagctgggattacaggcgtccaccaccacacccggctaatttttgtatttttggtagagacagggtttcaccatgttggccagattggtctgaaactcttgagctcaggtgatccacccgccccagcctcccagagtgctaggattacaggcgttagccactgcgcccggccccttttgactctttaaataaaccatgtacattatctgactacaggacaggctgagtcctccagtctcccgtgtgtggtcacgggatggggggagatggtggcagataggtgtctggttattcccagaacaatgtttcctgatgtcctttcctcgttggcttttgtacctgaggggataagcagctgttaactagaataggccccaggtggcaggaagaggctcctgggtcaaccaggaacaaaagaagctatttctagtgcagcatgaaattaaaaatcaaaagcatgacccagggttctctgtgcaggttcccctcttccaagacgggtgccaagtgatgagtatcaggtgtctatggtgagatttggggaggatcccagaccttaacagccctttggttgaaacctctcacaatgtggcaggtaagatgtctttattcccattttgtagatgtggcagctgagcctcagaagttacgtgacttgttcaaggtgacccagtttgtggtaggactgggagtgaaggactcttgactaagaatctttccagggagcgtttgccctttctgcactctctgcctgggtgctttcctccaaaatcctggcatgactggctcctttggtcattcagatgtttcatccctggaggctgccccaccctataagtctatcacgttatccttttcttttttttgagatggagtctcactctgttgcccaggctggagtgcagtggtgcgatcttggctcactgcaacctctgtctcctgggttcaaacaattctcctgcctcagtctcctgagtagctgggattacaggcacgtgccaccatgcccggctaatttttgtatttttaggagagacagggtttcaccatgttgatcaggctggtctcaaactcctgaccttgtgatccgtccgcctctgcctctcaaagtgctgggattacaggcgtgagccaccgtgcccggccttgtattttcttcatagcagttattcatatctgaaattgttgcttttatttgtttgctgtttccctctgctagaatgtgagccccatgaaaatgggccatgtctgtcttgttcaccactttacccccaggacctgactggtgcctgccacgtggcagatgctcaataatatttgctaactgatggaaatagtttggggagagagaaagagaaggaaaccaacatttaatgaaagctgaggatgtttcaagtacttctcacaaattacctcatttaatcccttcacagcctttcaaggtagaaatcgtatctccattgggtgaataagaaaccatgctaagtcaggtcaagtctgtggtttgttacttttgaggctatagactcgtctgagatccattagtataaaattttgcatcagctacgtggaggaattcacagaccttctcaggctcacttggggatctcagatcaagacacataggattggggaacttgcccagggtctttttggccccaggcctttgctggatcctcactccctggcaaggatggagtccatgtagtggactgtagggaacctgctgaagattccggagcagagggagatgatttgccctgagcctctggtgtctcagacctgagtttgaatcctgactgtgcagaagtcatctcacctctccgaatcccactttcctcattttattttttttctttctttcttttttttttttttgagatggagtctctctctgtcacccaggctggagtgcagtggcacgatcttggctcactgcaacctctgcctcccgggttcaggcaattctcctgcctcagtctcccgagtagctgggattacaggcacatgccaccatgcccagctaattttttgtatttttagtggagacagggtttcaccttgctgtccaggctggtctcgaactcctgacctcgtgatctgcctgcctcagcctcccaaagtgctgggattacaggtgtgagccaccgcgcctggctttcctcactttcaaagtgaaatctgttttttcctaacaataactaccctttattgatctggtcgctaagtgtcaggtacttggctaatgactttacagtcgttatctcactttcccttacctccctatcacatcagtatctttatagcctccattttacagccggggaaaggaaggcttgaagaggtatcctgacttgccaaagatcacagcagcagtgtcagccatggtgttcccacatatgtaccttgggacatgccatgggctcagacttcccaaagctaactgttgaatcaatttcatcctctgttcttggggtttgtgggaacatttgggtctgaattaggtgaaaaaaggtatgcagggatgtacttcactgtgaatggaggccaatcccttaattttgtgtcttgcctttctccctgcgagggcctctctccaagtctggactgtgggttttttttgtttttgtttttttgagatggagtcttgctttgtagcccaggctagagtgcagtggcgccatcttggctcactgcaagctccgcctcccgtgttcatgccattctcctacctcagcctcccgagtagctgggactacaggcgcctgccaccacgcccgcctaattttttctatttttagtagagatggggtttcaccgtgttagccaggatggtctcgatctcctgaccttgtgatccacccgcctcagcctcccaaagtgctgggattacaggcgggagccaccgcacccagccactggactgtgccttttgattggaacatctctgtcagccccagggtctgcatcacacatggtctgcatctgtgcacatggctactgtctctttttagcagtgatatcaccctgcctcatactgttgtttatgaggccatctccccacctggctgggggccactgctttggccattcagagtggaattcctctgtcttccagcccctagcacaggcctgggccagcattgctgctcaggaaatgcctgtggaatcaaagtgaggactgtcccaggtgttgaggatttactgtatgctaggcctgtccctgacactttatatgtgttatctcatttacacccccacagtcatcctgggagggagaagttactctgcctattttaccgagaagaaacagactaattgaagttgggctttgccttaggccctcttgtggtggttgatggcacgagggccaactctagggtctgtgccctggtcgtgtttgaggtgtgtgggctgaaaaagggaagacacacttcaaggctccagggatcctcagagaccttctactaacaggttcccagtccggctctcatttcatccgtgaggacacagaaggttagaaaggggagataacttacttatagaccctcttctccacttgttatatacttatgtatccacttactttttggcaggatggatctgttttgactcaacattgtaccacccatgtagcccagtgcctaatccaggttgatgcccagtaaatacttttacattttatttattatgaaaccactgagaaaggtataaaaattaacagaacaaatacctgtgtacctaccatccagcttgcaaaataaaacactgctaatataaagacctttttgtttccctccatgactgaccccccaacccaagaagtaaagactctcctgatttggtgtttattattcctatgcaatgtttattgagatataattcatgcaccataaaactccccctttaaagtgtgcaattcagtggttcttggtatatttacaagattgtacaaccattaccactgtctcattccagaatattttcatcaccacagaaagaaacctcatccctattagtagatactccacaattctccttctccccagcccctggcaaccagtaatttactttctttgtctatggatttgccttttctgaatatttcctgtaggtggaatcctacaatctgtggccttttgtaactagcatctttcacttagcataatgtttgcaaggttcatccatgttgtagcatggatcagaactttattccttcatatggctgaatagtctttcattgtacagatatatcacactctgttcctccactcatcagttgataggcatctgggttgtttccactttttgccattaagaataatgctgctatggccaggagtggtggctcatgcctgtaatcccaacactttgcgaggttgaggtgggaggatcacttgagctgaggaattcaaggccagcctgggcaacataaggctctctacaaaaaaatttaaaaattagccgggcgtggtggcatgcgcctgtcatccccactactagggaggctgaagtgggaggatcacttgagcccagtaggtcaaggctgcagggacctatggtcacgccactgcactccagcatgggtgacagagcgagaccctgtctcaaaaataattataataatgctgctatgaacattcatgtacaggtttttgtgtgaatgttttctgttctcgtgggtagatacctaggagtggaattgccgggtaatatggtaagtatatgtttaactttttgaggaactgctgttttccaaagtggcagcaattgtatcagagctccaatttttacatcctcaccaatacagttatccctctgtatctgtggggaattggttccaggacctcccatggataccaacatccaaggatacttaagtcccttatataaaatgatgcagtgtttcatatatgcttaagtcccttatataaaatggtgtagtgtttcatataaactatatgcatcctctcatatgctctttaattttgttttattttattttaaatttaaatttatttttatttattttgagacaaggtctcactctgtcaggctggagagcagtggtgcgatcatagctcactgcagccttgaactcctcggttcaagggatcctcctgtctcagcttcccaagtagctgagactacaagcgagagccaccacactgtcctttccatgtactttaagtcatctcggccgggtgcagtggctcacgcctgtcatcccagaacctcaggagaccaaggctggcagatcacctgaggtcaggagttcgagaccagcctggccaacatggcgaaaacccatctctactaaaaatacaaaaattagctgggcgtggtggcgcacacctgtagtcccagctattcagggaggctgaggcagagaatcgcttgaaccccagaggcagaggttacagtgagctgagatcgcgacactgcactccagcctgggtgacagagcgagactccgtctcaaaaaaagaagtcataaatgctatataaattgttatactgtattgtttagggaataatgacaaggaaaaaagtctgtacatgctcagtacagttgaaacattgttttcaaatattttcaagctgcagttggttgaatacacagatgtggaacccatggatatggaggtcccactgtacttgtctgattgtggccatcctggttggtcattgtggttttgatttgcattttcctaatgacaaataatgcgcatatcttttcatgtgcttattggtagtttgtatatcttctttggagaagggtctatttaaatgttttccttatttgtaagttatttgtccttttattattgggttgtaggaattctttatatattcaggatagtagatccttccttatatgtgatttgccaataatttgtcccattctgtggatggtcttttctgtttttcgatagtatcttttgaagcacatattttaaaattttgacgaagtccaatttatttattttttcctttgcttgtgctttgaatgtcatatctacgaaaccattgcctaattcgaaggtcacaaagatttacacttactttttctaagagttttatagttttggctcttaaatttaagtctttgattcattttgagttaatttttatataggatgtgaggtaggtcttatgcatttttaccctcctattaggtgtatttctaagcaatatatgacactttttcatggtatttgcacttttaagtggtaaattatatgattcttgtgcagcttgcttttctctttcagtgttatatcaggagatttatccatgttttaaggggaaatagttcattcattttcactgctctataggtttcattgcataaaaataccaaagtggcagcaattgtatgagagttttgtttattctcctgtgaatggtcacttgggttctctagtattttattactatatatggtaaaaagactaatagatgcctcctgtgcagtgtgttgaaggtcgtgagcatattcagacttacaaggtaatacaaagtttctttcccaaatggttttgcaaatgtgcactcctgccagcagtgtattagaattgccctcattctgcatcctcaccgagacagaatggtcaaggtttctagcttttgtcagtctagtgatgtgaaacggtgtctcgttgtgattttccagattaatagcaagatttgtttttcagtaagtgtttacatggttggatggatgaatgcatgaaagcagaaggggcccagaataaccctttactctgcctgttgttggaggatggcagggctctgggcctagactatgtggctctctgtagggacaccgtggagctagagaatgttgggggcaggctgacaactctagatgtgggagaggacggttgtcaccttgaaactagtgatgggagcttctctctacccagggagaggctatcgtcctgctcttccatctccttgaattttccaagaagggagggagtggagaaagagtgaagccaaaagagaattcctgggactgggcgcggtggctcacgcctgtaatcccagtactttgggaggccaagacaggaggatcacttgagaccaggagatagagaccagcctgggcaacatagtgagatcccacctctacaaaaaatttttgtaaaattaaaaaacaagggaattgcctaaggatgagaggtcacagtggcctaagtgacccttaggaatgaccctttttctgggactttttcatgatctttatattggtgtgacatgaactttccttgtttaatctactgagtttggagatggtcttaatgataataagaaaatgaatagtaatgattatatgttgaactcttatgtgccaggcacttacgccttttctttttaaaaataggtattatctcattcaattcctatgggacaggtactattagtattcccattttattttatttttaaaatagggatgagtctcactgtgttgtctaggctagtctcaaactcctggcctcaagtgaccctcttgccttggcctcccaaagtactgggattacaggcatgagccaccgcacctggctcattcctgttttatagatgaggaatcagaagatcaaagagacagagcaactctgagggtttgcacataggcagttggactccagaactcttaggcatcatgctgtgtggttaacctggctcagccgaatccactagagcaaagaaaagagaggcttgcccaggcttgggtgagaaacaggagtcagaatattcactgggcctggcctgagggcgcagcagggagcagagcgagaggccgctgggaaagatggttctcaaaagcagaagcctcacgccaggggacatggcccatcagcaagcacatgggtgcctcttctgggcatgctggctgctggggacccagaatgggatctgtctgctcctgggtctcaagaaagacctgtcttgtggggtagacagatgataataagcagacttacccataagtgtaatacactcagaaatggggacatgtgatacagagggtgaagagagaacctttatagaaaggacctagtttagttaatgtagtcaaaggaagcccctttgaggaggtgacatttgagtggaggctcgagaagaaggaagcagccatgccccagtttggggaaagagtaaatggcagatgcagagtccctgagacagaaaggagctggtttagttgtaaactctcagaaggccactgtatctggagtgatatgaatgagagggtggggctactgtagatgggctggtcagttggcagggccaggtcaggctgggtctccaggccagggtcaacatataggtctatagccaacatgtttaaataaggcccataagactgtcttcttgctgtccctgagaactgggtgtttgcatatttggaagggactgaatcctgatgcctaggctgggaaagagggtcggggggtggggagaattcttggcttctggccctagaaagctggaacaagaatttggaggctgcatcccactgactcccagatgggttggagggtgggtggcctcagccaccagggccctgtgataaggtggcaccacatactgatagctgtccagatatccttccacaggtgaacggttcatcaaactgtggcgcatccatacataccatgagtaccactcagcaataaagacacaaacatgaaatgagcaacaccttggaagaatctccagggacttatgtggagtgaaaaaagccagtctcaaaagagtacatcctatatgatttcatttatgtaacattttggaatgacagttttagaaacagaggacagactggtggttgccaggggttaaagatgggagggaagttagtgtggttctataagggcaacacctttttattgttagaactgttcagtgtcttggtggcagtggaagatctgtgaattgacacgggtgatgaagtcgtatagaacttaatacatgcagatgtgcgtgcacacacacgctcacaactagtacatgtaaaactgggaaaatctgaataagatcggtacattatatcaatgtcaatagtacagagttactgtactattgcttacaattgcatgcgaatatacaattatctcaatagaaattttaattaagaaatgaaatttggctaggcatggtgaggcacgcctatagtcccagctacttgggaggctgaggcagggggattgcttgagccaggagttcaaggctgcagtgagctatgattatgccactgtactcgaacatgggtaacagtgataccttgtctttaaaaattttttttttaaaaaagggaggctgagcacggtggctcacacctgtaatcccagcactttaggaggccgaggcgggtggatcacgaggtcaggagttcgagaccagcctagccaacatagtgaaaccccgtctctactaaaaatatgaaaattagctgggcatggtggcgcgcacctgtagtcccagctactggggaggctgaggcaggagaatcgcttgaacccaggaggcggaggttgtagtgagccgacatcacgccactgtactccaggctgggaaacagaacgagactccatctaaaaaaaaaaataggaaatttaaggcccaaagcattagatagaatgatagagatatttgtactaataaaattttcagcccatggaaaaaaaatctgaaggctctgctcaaggaggtctcttgtccttgagttagcaaagtcacagggaggtaggcagtgtgcccccagctgtgggagcaagcagggtcaccctcaggacactcaatatagagcggtggtaccctcagaccctctgggtaggtttcccagcttagccttttgggcctccctctgcccctcacccctcaagctgattgaccacgatcacaagggtagagcagagctacagcaccccccgccctccactgctgcttggtctttcatggagaacagacattctcctgctccccactccaccaggttaggtaaggacccttcctggggaggcccctgtgtcaactgtgcttaaccgtctgtgcctgtgtgtcccccagcagcctaagactcctgaaccttcagaacaaacctgatgccaattccaacctggagggcacgggagagtgtttgtttgaagcactgaactacatgggaaactgaccaagcctggggcaagcccatcctgagaccccaggcagggcctcagctttggtccaggatttgtggggtggttttacaagatcctgggatttcacatgtgggccccactaagacctctcttccagaatgttggctgcattgggcactgtctcaaattccacctacagagtggcagacccaaggcttcccgccatagtaccccaacacccacagagccacagctgcatcctcaaattaattgacatcttcccatgggctgagcactttgtttcatttatttctctcaaccacattacaaggtaggtcttctttgtgtatttattttgcagagaaggaacccagggctcagagaagttacgtaacttgcccagggtcactcagcttgtaaatggcagagcaaggatttgaaaaggcagtcctgacatgtggcaggcctgaacgagtccctgcagatgcaaagctgaaggagaaacattgcctgctcttaaggagctaatgataatatcaccagatatttacatagtgcttatgatgggtcaggcacaggctaggctctctgcatgtgttatttcattgaatccacaccacaacccagtggaataaggttatgcctgttttatgatggaaattgaagctccgtgaggaagagggacctattcaaggtcacatagtgagttggaaagtctgacctcctcttgttggcttcttccatcctccaggctggcctcccaggcccctccctgctcgtggtctgtacaccccttctcccttacactcggctaagccttgtccatggcccctgcccctttcatgtctattcttagcatagtttggagcctgcggttgggccacattatctggatggtgacccctgggggtacatcttctaccccagtgtgtcctttagcccttcctgtctcttccagctgtgcagcaaggggcgtgttagaggggcccactacccaggcccttacactgcggcagcctacctaagtatgcacagcgcacgtagcgtagaggatggagcccgcaggacacccttaatgcccttacctggcagggaggccagcacacaaggggctgggggcgggactgggcttcttggggttgagtggttctggaagccgatatgagcagcagcaactgctggcattatctaggctctaagaatagcttgggatgaagagtcagaggttgaggccagggaagaggacaggagcctgttcctactgccccctcctgctgcttggcctggaagctgggaagcctgcctcctggctcaccatttgctctgggatggttttgcatagacacatcttgtccaccactggactggaggaaagagggtacccctgggactcagacctaggctgcttgacctcaggctgaaggcagtgggcccactctctgaggaccagccctcacccaggcccctcaccactggcacagagtaggggtttgtatttttcaaggatcatgctggaagtgacccttattcatttagcaaacactttaaaaataggttatacatacacgatttaaagttcaaagggtttacaagggaaaaaaaatcactctgcctcccttccctggcccccagctaccaaacactgttaccagctttcttgggtgacttccaaaggcagtccatccatagataagcacacagatgcacaaatgtctctctcccccgatttttacgcaggagatggcatagcccatacattcttctgctccttttttttttttttttttttttgagatggagtctagctctgtcgcccaggctggagtgcagtggcacgatcccggctcactgcaacctccgtctcctgggctcaagcagtcctcctgcctcagcctcccgagtagctggattacaggcacctgccaccatgcccagctagttttttgtatttttagtagagacagggtttcaccacgttggccagactggtcttaaactcctgacctcaggggatctgcctgcctcggcctcccaaagtgctgggattacaggtgtgagccaccgtacccggccacaacttttttttttttgtaacctaatgatctatcttggaaataacagcaatgacatattgagtctccactagtgtcaggtactattctaagcattttagatggtttaactcatataatgctcatcacagcactaggaggtaggtcctgtttgtgaatctccaccattaagaggtttagtcattctccaagacttcgtgcctggtaactggcagagccaggactaaaacccaggcagcctcactttagatgaggtgctccttcctcactgctctgtgctgcctcccaagcttgagacatgttgagactcacatcatgccctccctcttcctaagggccaaggtaagccatgtacggtgaacacttaccacgtaccaggctgaggctgggctactgcagtgtaagggagaccaggcctctgtcctcatggaactgtcatcccagtgcccatgagtgtctgccagccaaggcaggaggagggaaacccacttgtctcatacccatgtgcccttgtataggtctgctgttcagacacaccctggtcccatgtccactagtcctgtagtcacaccgcctctgagctggaaggccttagagcccagagttacagatgggaacataggggcccaaacagaggtggacacgagagatcatcaggtggccctggtgagactcatcccctgcctcccgggatctatttcagcagggtgggtggggggtgactttaatccagggcccaaccattgtttgaagttggaaacaattgaaggacaagggagctatagatagatccacagctgctgtcacttgtcccagcctgggcactgggcctgagcattgtctacagaggggcactctaagcagtgaggcccactcctgggggtaggaggttggcccagcccagctcagctcagctcggctctagagataaagagtcagaggccaagacagaaatacagagtcttggaaggcagagagtgggacaggacaacatcgaaagaacaagacccttgagagatacgatggactcccatcaaatatcgacaatactcagactggctgggggtgggagggcagacgcagggcctgagccacaggttgaactcaaggatgcggcatgtcagagacctggaccagagtgggtgctggggtctggagcacctcagcccagctcaggtctttctgtccatccctccagaacagctgttcatgttaatcactcttgggggcagccagtctgaggtacccttgtgtgtgctcggggaggcctcaaggtcttccgaagtgagaggttgtgctgtcaggcctggtcatggcttgaattcactgtatgacatcaagcaaggacctgcctctctctttgcggctcagtttccccagctgtccaatgagagagctggttggcatgatggctgaagggccccttcatcctccaatgatgtcaggagatttccttttatgtgtctaactccctcctcttgctgtggctgaggtcgcagtcccctcctttctttgtcctttgtgaagatgggggacagctggttccccaccccctccccccagtaacctttcagccataaatccatgctgaggcatctctcctctggataaacagccctgatgccttttggctgccctcgtcctattttttgcttcaagcctcagagctggggcccacttgggccctctgcagctgcccagggccccaggaggggtacaaacctgggacaagcaggggcccaaccacccccagtgtgccagggtcgtgggcccctttctgggcctcaccaccttgcactgggaccattatggcagcctcctcctgagtccttcttcctgccaccggcctcaccccttcagtgcatcctccacaccagctgccacagggagcttaggaacacataaatctgaccacactgtcaaattccgtcgctcagagctctttgatgcaaaaaataaataaataaaaatgcctttgatggcgccccaactcctgcaggataaagctccagatctgaatctggcctttgaagcccttcacagtccagcccactacccagtcctgccccactcccctttatgcccctggtggcccagctgcagctggtggggctgcttgggcccatcttcaccccctaccctgccttggagttctaggtcatgctgtccatttcctgtcccctcttgccacctccatgccagacccatccgctctcacccgggtgacagcagcagctcgccccgctgcctcccctgccccttccaagccgttcaagtggtcactatgaaacttcagctcactcacatttctgctctcacaggctccctttgcacttgcaatacaaccctgggtcccttccaagtccttcaaggctctgaatgatctgcctgtccaccctcaccttggaaaactctccccttgttgaccactaggacggcaccttaaacatcccaagctgttttctgcctcatggctattgtatttgctgttccttctgcttggaatactgttccaagggcttcccgcctcaccggcttcttggcactctctggtctcaccttcagtatcgcctcttcagagaggccctccctcacccaccagaacgaagtacacgtaccccattaccctccaggccatacttcttgtttcatgcttaccacttgccacaatctttaattaccttaaaaatgtgtttgcttgtttattttttgcttctccaggggagtgtcagctctatgagggaaggaaccttgttgccatacccctcttcctggcagtctgggtgtcacacttgtttgttttgagtcagggtcttgttcctgttgcccacgctggagtgcagtggcatgatctcagctcactgcagtcttgaactcctgggatcaagcaatcctctcgcctctcagcctcctgagtagctgagattgtaggcgtgtaccatcatgcccagccaatttttaaattttttgtcgagacagggtcttgctatatcagcctaggctggtcttgaactccttggctcaagtgatcctcctgcctcaagccttccaagttactgggattatcataggtgtgagccatcatgcctggttaattttaaaaatatttttttgtagagatgtcacagggagcttacaaacacataaatctgaacacactgtcaaattctcttgctcagagctctttgatgcaaaaaataaataaataaaaatgcctttgatggcgccccaactcctgcaggataaagttccagatctgaatctggcctttgaagcccttcacactccagtcccaactgctcagtcctgccccgctcccctttatgccccagtggcccagctggtctcaaactcctggcctcaagtgattctcccaccttggcctccaaaagtgcagggattatgggcataagccactgcgcccagccttcaaactagcttttatccttcagactcctccgtgttgatgtcttccttgagtatctttcctttcctagacaatgagtgtcttttgttccatgtgtccctcccagctgtagaagcattattcacagagtccttcgatgtctttacccaaagaagaaattccaggcattgggttacattgagggcagatacattttgggctgggatctaaaatcctggagtctcgctctcctgaaatcggaacgaacttcaaaggtcatccagttcagaggcctcagccctggtcgacctctgcctgagtcttccttggtgctggcaggctcactttcctccaaggcagcctctcccgctgctgatgggctgagatggtgaaaagtccccttttgcatgcatccgcatcctgcttcctgtcgctgcccatggatctacttttgaggctacacaagtcacatcagctccctctgctccaggacagctcttcaagtttttttgattttttgttttttgagagggagtcttgctctgttgcccaggctggagtgcagtggcacgatttcagctcactgccacttccagctctcaggttcaagtgatcctcctgcttcagcctccccaagtaggtgggattacaggcacacgccaccatgcctggctaatttttttttttttttttgagacggagtcttgttctgttgcccaggctggagtgcagtggtgcgatctcggctcactgcaacctccgcctcccaggttcaagtgattctcctgcctcagcctcccgagtagctgggattacaggcgcctgccaccatgcctggctaatttttttgtatttttagtagagacagggtttcaccatgttgaccaggctggtctcaaactcctgacctcaggtaatccacccgccttggcttcccaaagtgttgggatgacaggcatgagccaccatgcccagccttttttttttttttttttttttaagtagaaacggggtttcatcatgttggccaggctggtctcaaactcatgagctcaaatgatccacctgcctcagcctccgaaagtgctgggattacaagctcttcaggtattgaaagtcagtatcttacttaagtccttgcaggttatagtatttgttgcaaatcactcagagcattgggtttcctctttgcgttgtcatgtttgtttgtgagcttatctcagcaggaagatgcaccctgggtggtggaagggaacctacgaggaagatctagacccattttgaggcttggtttctcagccccaggttcatacactgagtaggtaactctaggactcagacccacatgataggtgtaagttagacttgctagaggttctgattctccaggctaattctgttggtccctgacaagaaaccctaccttctgagcatccttgaacaatgaaaagaatttttcccactttctgggctttctataaattgctccagcccagctctccagcctctgatgccataggagattaaaatcctattatctatcaggtttggttcgttcacttactaggtatttattgactttctatgatgtgcaggcacttggcaaggtgccggggacacagaccaagctcctgcccttgtgcaggtcttttctagtggcaggaggtaggcaaggtacaatctaagctctacaaagagaattgaaacagtgaggttctcacagagacaatgcggagagaaagaagaaaggaatacataatgtaggattccattcaaacaaattctgaaaatagacaacactaatctctgaggttagaagtcagtattatattgtggatcaagcaagagtcggtataaaaaaaataaaaataaaaaagaagtcagtattctattatcctaggtgagggatggcccgaaggggataatttttcataatttctgtttttgtacagggtacggttttgttttgttgttgcttttgagactgggtctgttgcccagctggagtgcaatggtgtgatctcggcgcactgtaacctctgcctcctgggttcaagcggtcctcccacctcagcctcctgagtagctgagactacaggtgcatgccaccatgcctggctaatttttgtttgtttgtttgtttgttgtagagatggggttttgatgtgttgcccaggctggtcttgaactcctgagcttaagtgatgtgtccgcctgggcctcccaaagtgctggaattacagacatgaggtactgtgcctgacccagggtatgtttactttgagaaaattcatcaaactttataagatcattcactgcagccttgactgtaatggcaaaagactgaaaacaatcgaaatgtctaccgagaggggacccgcgtcatttcctaatggagacacactgtaggactaattcctaatagggtctgggcggctgtaattttgataaatatcgccaagtttggcactgtaatttttttttgagacggagtctcgtactgtcgcccaggctggagtgcagtggtgccatctccactcactgcaagctctgcctcccgggttcacgccattctcctgcctcagcctccagagtagctgggactacaggcgcccgccaccacctctggctaatttttttgtatttttactagagacggggtttcactgtgttagccaggatggtctcgatctcctgacctcgtgatccgccctcctcggcctcccaaagtgctgggattacaggcgtgagccactgcgcttggccggcactgtaattttaaatgtgttcatgtaatatgcacacagtaaagtgcatacatcttagatgtacagcttgatttgttttgcaaagtgcacgcacctgtgtctcatggctctactcagcgtatagagcatttcctgcctcccagaggctctctggtgcctccagccattaccctccctcagaggaccactctgccacttctgtcaccataggcgagttttgcctgttttgaatgtagatggttgaaaatgtagctgggaaattatttctctatatttcgtctagcacacctgtgcatttggaatgggagcgcatcggtcggaggacttcccgtgtgagcctggtctggcctctggctggaaccctggatctggaactccattgttccatgtgtctggcgtctgaggttctcagatcctttcattctcgattctaaaatcctgtggcgtcacggagccctgaatggggtgatggacaggagagcctggaggtgccctgacacattccaaagactgtatcaggcagatggactgccagcgccctgaacctctgtcgagagtgggccacgggaaggtggcttcctgtgaatcttcaatgtggggatctgaaggggctcctaactgggttacatttccttgatttgcttccatttcagccaaacaattccttgattctataagttccagggctggttttcttcatgtatgatttccccagggggtccccagaaagaggatggggagggaggaagagggaaagagggcatcgatgtgctcccacttccaaatgcacaagtgtgccagataaaatatagagaaataagtgcaaagctacattttcagccatatacattcaaaacaggcaaatctcgcctatggtgatagaagtggcagagtggacctctgaggtagggtacagagtggaggcaccagagagcctctgggaggcaggcgatgccctataccctgagtagagccgaggggacacaggtgtttgcgctttgcagatgtctgagaaggatgtccctctccccctacccctcccccctctctctctccctctcactccttctctttttgatctgttcttctccttctctctccttctctttttgatctgttcttctccttctctctccttctctttttgatctgttcttggccattgctcgtctgtgagacttggccaatgctttcctttctctgggcctcagtttccctggatgtatcaagagggttggactagctggtccaatctcagtaggcattctgtggtttcccctctgagtgtccttgctctctgtatctggaggtggggtatttttctgggtgtgtcagactctgcgtgacttggtttctccccgtgagctcttcagtctcctgaacctcttactgccttgtccctgtccccgtcagtctctgcacccagcctccctgtctctcagtggagtgtctctctccgcctttgtgatcccctgacaatgggaggtaaaaatagcccaggggccgtgctggtggagataaaagggaatttgccttttgtgtcctgtggccaggctgggggggctgtgacacgtggagattgctgacatagctctcctcctctgaccttgacagtggcaataaaaggggtagcagagcttcctgccctcaccgtggtgccgaggtaggtgatcagggctggggttggagccgaagggagggcaggagggtgggcgggtgggtgagggtgcccatgggtggccgcgagtcttctgaatctggagtggaggaagccctggtgtttgagggtgtgcatgtatgctgggcactcacccaaggaggctgcattgggagccagagggagtcgcctagtatctggtcttgtgggttgggggatcgtgccctagttcagctcccttgtcactgccatcttccagtgcctgctgccttgggccgccttgaacctccagggtttccagctcctcctccttcaccccagtgccactgccatgatggatgtgagtgaacttggggagtctgcccgctacctccgccagggctaccaggagatgacgaaggtgcacactatcccatgggacggtaagtggagacagagggggaggggtcatagccacagagatgcccttatggactcagaccaggaattgggaggggtggcaccagctcagggctgaaggggcattggggcctgacagctggagccctggacctttcctgcagagtctggggcctggaaattaaaaccccagggacactgtatatcactgtgtgtctgtgagcaagccttggtttgttcccctgtgaaatgggataatagcacctgccttccggagctgcagtttatgaagactcaggctggagcccgaggcctctgagatgagactgatcggcatgtgtgcaggctgcctccgcgtgtccacaaaacttgtgctggggttatttttagtggtttctgcagagccaaagccaccctttattagggacaggaataaaggctgtactatttatgacctggtttgctcataggacaatactaacaataggcagtgtgtaccgaatgcttattgtgtgtcaggcccagagcagatgactttccatgcatcatctcaacaacctggggaggtggggccagcaccagacctagcttcacagggcgccaggctaagagggaccttgtgtttgattcgacactctgctgttgccgtcttgaaagttttaattgttttcaacaaggggacccacatcgtcattttgtactggggtctgtaggttatgtagatggtcctagatggttctagatggtcctgacccaggcacttggcagagcaggggacacaaactccggtttgcagcctgagtccatgcttctaaccaccatgaaatctgggctcctcaaagctctggggacagctggccaggcaggagagcacaggttacagttaggaggcctgggtttgagtcttcagtgaaatagggaaggcaggacccctccctaagagtcatatgcctgatattgaggggctgctctgtatgggacctaaggagatctccataacattttgcatgtgagggaactggcccagagagaatcagggattttcctgaggtcagagggcaaatatggcggaagcaggaattggaacccaaccattaacccagactcatcctccaataaggggatctctagggaccctcccagctccgcccttcctgagcctgggtttggagggttcttcactggaactcctgggtcctggcagaggggctttggggagggtcacagctgtatggataccatggcttgggaactccagctagaacctggaggtgcctcagcccctctctgagtccagagctctctctgcaacccagggaagaagcgagtctgggtgcctgatgaacaggacgcctacgtggaggccgaggtcaagtcggaggctaccgggggcagagtcaccgtggagaccaaagaccagaaggttccgttccccctttcctgagattagcctctctgtccctaggcctcctggccaacaggatctgccctctggttgaagggggtctgggtatgtgggtgggggtgacaggtgaggtcggtcggttcctcccggtcccccggcccctgacacgatctccctggtaggtgctgatggtgcgtgaagccgagctgcagcccatgaacccgcctcgcttcgacttactggaggacatggccatgatgacgcacctgaacgaggcctctgtgctgcacaacctgcgccagcgctatgcccgctggatgatctatgtgagccccaggcccgggccatgggcggggtggggcttgtatgtggggcggggctagagatgaggtgctgggggcgggcccatagcggtggggcggggctgtgagcggtggatcggggctgtgaatgatagagcgggtccatagcgggggtggggctgtgagcgatgaggcggggctctgagcagtgggggcggggctggaggttgggccttgggaccttaggggagcagctgtagcagtgcggggcgggtctagaactcacctgcggactatggaggccgtgcgtgtgggctggggcagggctgtgagcacaagtcaggggtgaggccaggacggccacagagggtgtggtgtggcaagtcaagtagctccttgaggaatatcgcagggttcttctgaagactggggcctggggcctggggatgggaacttgcgtatccctcccaaaaccctacctatggggggagaatgtggtggcccatgcctgtaatcccagcactttgggagggcaaggcgggcggatcacctgacgtcagaagttcgagaccagcctggccaacatggtgaaaccccgtctgtactaaaaatacaaaaattagccggtcgtggtggcacgcgcttgtagtcctagctaccctgggaggctgaggcaggacccaggaggcggaggttgcggtgagccgagatcatgccgttgtactccagcctgggagacagagcaagactccatctcaaaaacaacaacataaaccctacctatactctctcttcagacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcagtaagggccgcctggactcctccccaaccgcagaccccgacctcggtcccgggaggcctctgtaagggacccccttcccccactggcactgccccccttttgacgctgctggacatggtcgcccagccgttctgtccctccgcatgggagctgacctccactagggacagccccacctgctccttcccattcctggctctgggtggtggggtctgccccagatggatacccagggtgttccacctgtggctggccccacaccttggctgacttctctatccccttccctttcctccagaccgagacaaccagtccatgctgatcacgtgagtgtggggctctgggggtggggtggaaaatgctggccatctggcagaaagagggcggtaccacagtcatttcccaggattgaatccaaagtgcttaggccaggacttttaccacctggagctagtgtcccagctgaagctaaattaggcctgagcactttccctgcccccattctgaacagatgtgttcttgatgggggatagggaggggacacccacaaacggagtgaccaccagccccacacctcctctccccggggcctggaatctcccaccttgatcctctggggttctaattctggctcaggggcagcggaaagattcctctgcttttcctcctttttaccatctacttatgtctgaatcttacctctgatctttccattgcctctgtgggaaaatggtagaataattcttacatgccaggctcatgtccagtcaggccaatatggacaatgtttagtgtgagtgtgcatgcgcgtatgcagttaagagcaagtgccttggccgggcacagtggctcatgcccgtaatttctgcactttgggaggctgaggtgggtggatcacttgacgtcaggagttcgagaccagcctggccaacatggtgaaaccccatctctactaaaaatacaaaaaattagctgggcgtggtggcaggtgcctgtaatcccagctactcaggaggctgaggcaggagaattgcttgaacccaggaggcggaggttgccgtgagccaagatcacgccactgcactccagcctgggccacagaatgagactccatctcacgaaaaaaaaaaaaaaaaaaaaaaaagcaagtacctttaacccagacgggcccggctgagtgtggtggctcacacctgtaatcccagcacttggggaggctgaggcaggaggattgcctgaggccaggggtttgagaccagcctgagcaacatagcgagaccccatctttaccaaaaaaaaaaaattgaaaagttaaataaaaaatcctacctaccacacaaagttatgagtcagtgagttgatatatgtgcctggcacacagcagggacagccacagaactcctgaggcccagttccttgttcctaaaatgggggtgataatggagcctgccttccagggttttctgagctgtaactgagccaatggagtaaagtgccgggcactgagttagtccgtagtggacaatggcatcatcgtgtgttgtcatctcacagggatggtctacactggcttgctttgtacacctctgagggttgatccatccttgggggtttcaagctggggggaaggagaggtggagggctctgcttgaggggtgaggcattgggggtgggggagaattaggccagatgggcattggtgactcatgtttgtgtcgtccaagcggagagtcgggggccggtaagacggttaacaccaagcgggtcattcagtactttgccatcgtcgctgccctgggagacgggccgggcaagaaggccgtaagacttgcccactcgggcatgctccccgttgcttctcgctgtttttcttttctttcttcctctcttttttttttttccccctttttaaaaattttactccccagaaccctgagccctgcctgagcctcccaccctggtgggggactctggcctgagcaaggcttgaccacaaaggctgtggccacctgacgcgcctgccttcgccttcccattggtaaacatggaggggtggggccacgttgccgtttctaaatttgtgtaatttttatcttccattgtgaccttcatatattgaaagagtttactagatgggctgcttttactaagcgttgttgtcttggtttccctgacagttacctgctgctgacacattagacacagaggttggctggcatgcagggcactgggcattcccagcagccggggttggcagggcaattttgtgccttgtgatttctgtacagtttttggaaatttctgaaacaatggggccaagtttttttgtttttgtttttaaggcataacatttcatccctagccttggggccagttgttcagagccctgtggctacccctagatgggctgcctttttccagaagcccgaggcctccctccccacccagtccctgctcctggtcctgttaagccttgctttattctgggtgtttttcttgtttttcccctgttttctttctttctttcttttctctttcttttttctttcttttcttttcttttctttttttttttttttttttgccttttcctttttacccatttgattgtcttgatttttgattttcatttcagttttgttttgttttgtttttgctgttgactttttggtcctttttcctccttccctttcctgccctgtcttccaaatccctaaaaaggtctctggggacgtaacagaaagttgggtgggtcaagtgacaggaagagatgtcagggagaggccagagctggcagggacacagctggaagggcagaggagcacctgggcagaaaggagctgggacagtggagcccaggggagagggtcgggcaagggaggggtgggagaggctgcccgcaggagccatggctgcaggaacttaaaagattgatcagctccccttaccttggccccaaatttggccaaacgggctagagagagccctgcacaaaagcactggatgggagtgtattggggggttccacctcccctgcccaatgtccctgtgggtattttaactcttgggctccctggaggtgaatgaatgaccacaaagtccgtggtggtatatctgttccctccagaatccattccttcccttctctccctttcttccttggctcccagcatccggagtagggaagagaaggaaaggaaaaggaagggaaagtgaggatgaggctaggatggggagaaggaggatctgctcaattcacttagtccccctgggtgacacacaggaccgctgtggcgtccaggcggcaggatgctgggcacctgccctgccgctcctgacttgctgtgtggccttgagcagatccactccctgcccagagctaagtctcctcatttgcaaattagggctaataatgggcacctggcagggcctttgtgcgcactggtaggtatacaggcagacaaacaatgaagacacacccagttgcattacaaaggagaggtgtgtaaggtcatagtgggaggttagggcaggaaggttcagaccaggaagaggtctattccagctttggagcagccaggaggccttcctagaggagggggcacttgggctgggctctggagggccctagattttagtcgggaggcccctggggcttggagcagggccactgcatggagactagaaaatgaagggaggccagaggccgggctggggcagaggaggctgcaggtggagactctggctggggctgtgccactcccactttccagcattttgcctcctaacagctgcaggagggtcaggccgaggggctgagggtgggggccatgcattccggtgactaactccacccccctgtcctgctgcccgctgcctcccgctgataccctgccccaccccgcccttccccaccggaggcctggccctctaatgttgtctgtcttcttcccccagcaatttctggcaacaaagacgggggtgagtatggggccaatgtcaatggggcagccctgggggtacccccttcctctgcacaacagaggggccacgggtggctctggcctcccggtgggtaggcaccagaactgacagaccccctcacccccaccgccccagggcacccttgaggatcaaatcatcgaggccaaccctgccatggaggcctttggcaacgccaagaccctgaggaatgataactcctcccgctttgtgagtggctgaggtgggaggggtggcggggatgccgtaggccaccagcggcaggtcgggcacaggtggggacagtgctggctgtgccccttggctgagggctgcccctctgcccacagggcaagttcatccgcattcactttggtccctctgggaagctggcatccgcggatattgacagctgtgagtcaaccccctgcgggcggtgcaggggaaggaggcctgagcccggtcaccccaactcggcctctgtcatcacgacttctgggctcctgcctgctctgggcacttctctctaccccctggctgctgcccagctcaggccacctcacctatcaccagaacatcaccccagcctctgcctggtctccagcttcctctcctctacgcggccatagttttgctggtcatatcctgttcctgcttgaaagctttctctagatcctgtcacctgaggatggagacccaaatcctcatttggccagtcaggctcctgtgactgcacccctagcgtgtccccagtcttctctctggccaccaagagggcaggcctggcccacggccctcctgccccagctgcacagctacacgtagagtgccccatccttccaggcaccccgctgggaagtgccccagtaccaccagctgcatagaccccaggcgcctaggccacactcaagggggccagggacacagaggggcccccacgttggccactccccacattgggctgcatggctaggtcttgacggatgagcgcaggcaggcagtgacggggacagggataggctgtaattcacaccctgacccctacacagacacacacagacacacacggaggctcggccacacacgcacacacgctgacacaccaacagataaaaacctgcacacgcagacaccacactcaccccacacacacgcaaggacacacactgacccatctggccagagacacagacacacaggtacagacacacggctcgtgtgatgacgcaggcacaggggagataccctccccacacaagctggcaggtgcagatgcagcccccctgcacactccctgcccacctctctccctccgcatcgcccccttgggatgtccactctggggaggtgtgggagatggcaggccagcgtcccttctccccagatctcctggagaagtcgcgggtgatcttccagttgcctggtgagcgcagctaccatgtctactaccagatcctctcagggaggaagccagagctgcagggtgaggggcagtacgatgaagggggtgggagtcagaacctggaggggctgcctggcgcttcctggcccccatcaggccaggccctggtggtctttccctccctgtcctggggtctgtggcctctcttccttcttgggacttttggttactttcctgctagggaacagtcctcttagctccagcaacctgccaacgtgttatcgctgcctccaggagcctaagccctaaaccccacttgctgtcctgagactagagaggtcccacccagcaccaaggcggactgatgactgtctaggcccagctctcctctctggcaagcccgttgagggcagagtctggtcttccctgtgcgccagcatctagcatgggatctgggccagagggggccatgagcaacagtcaaaagatgagtgagacgtgaggactgtggctcattcctcagagaaccagaaaaagaagccagggtcaaagtgaaggccaggtcagggcccttcactctcagtgccctcagccttggcaggagtgaggatgagaaacttaggccccagactgggagatgaggtcctctgggagggccctagactcctgctgggcttgcccccgcaggaccccctatgctgcaattgttgtggggagaatagccggtaagcactgcctgaccctcccttctctgccctgtgtccccagacatgctgcttctgtctatgaacccctatgactaccacttctgcagccagggcgtcatcaccgtggacaacatgaatgatggggaggagctcatcgccaccgacgtatgagctctggtgggaggggagctgtgtggacgcctgtggtggaatcgggcagcactgccggtgcccccagctgcatgaatggtcccggggcagtgcctggctggaccctggaggagcccagacctctctgaactcgctttccctgctgccccccagcatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgaggggccctaacctggccttcaacttgacccagacctcagcatcctgtccatgatggttaaccccaactcttgtccacaacctttaacctcagtcttacctggccctgcctcctcagctccaaacccttaccctcctgaggctttgtttgctagccctgaacttgacccctcttaacttccctctcctagccccaggctgaggcagtagagcccctgagtgcgcatggtggtgtcctcctcccttaccccactcgtgccctgccaggtgctgacaaggctgcctacctgatgggggtcagcagtggggacctcctcaaaggccttttgcacccccgggtgcgtgtagggaacgagtacgtgaccaagggccagagtgtggagcaggtgagctgcctgcaggccaaacccatgggggacagccgggcagggtcccctccttgccaggtcccagcccagcctccctgcacctccaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgaggtgaggacaggccctcaccttggcctctgttctctccaaggtagaggacatgggcctgtgggggggcagaagccctggccttctgcctggaagttgggggtgaactcatgcccctccccgggcctccctttccccatctgcgagaggtctgctgagccaggcccctccctcttgtagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaaggtgggtgccgcggcaaggtcactttgaggaagggagggtgtgtgtggtgagcaagcagggatggatgaccatggcttgcatggaagcctgcaagtgtgcatggaagcgtgtgactgtgcgttgcagtaagcatgcatgtgagtgtagttgtgacagcgtttatgtgcttgtgtgtgaaagggcacgtgtgtgagtgggtgtgttggagttgaccatgagtgagccttggtgagtgtgtgagcagtgtgaatgcatgcatcccagtactgtggacaacagctcctcctgggtgctcagaattctgcagctcacaaggccctatttgcagccacaatttcactggatccctagaactgccctgggtgcagggcagggtgtgtttccttgtttttgtgattgtggaacattatgtatatttacccattgtacaaagaatggaagaaagaaaatttgaaaaattggcaggggaaaaaatgtttctccccattcctatcacagccagtcacatgacacttaggttcatttcctcgaaatcctttatccctttttttttttttttttttttgagatggagtctcactctgtcgcccaggctggagtacaatggcaccatctcagctcactgcaaccttcgcctccagggttcaagcaattcttatgcctcaacctcccaagtagctgggattacaggcatgcgccaccacacctagctaatttttgtatttttaatagagacatggcttcaccattttggccaggctggtctcgaactcctgacctcaagtgatctacccaccttggcctcctaaagtgctgggattacaggcgtgggccactgcgcctggcctatccattttcttttatagacacagatttcatttcatatcctactttttctctgaaaatgtattttgaatgctgctcatggcaagagtagttcatgcagtggatgagtttcatacgatgcatttctgcagtcccctacagctgggcgtttaggtgattgacagctttttaaatattatgtcagcactgaagacattcatcttcccactctgcaggttagaagactgaggcttagtgatgtcggagggccccacagctagtgagtgaggaagccaaaatgtgaacttgatggctttttttgacttaccccatgtttgtgtgtgacagccatggctgtggcgggggtgagagtgggtacagagatgccagcttgggtttgccattgttagaagtgaagatgacacctcagtgctgcagattttgcaggaggggactggagccaagccacaaacttttctctgttaggagatgggttcttggagtgggtgtggtgtctgaccatccggggagatggctgaagctggggatctgggaaggctcccagaagggaggtggcctggggaaccaggggttcagtccttccaggatggactggcttgatggtggcttttcaagctcgttctgttcccagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtaggtgcttgctggaaccccagccctcggccaggctcctcccgccctgctccaggtctcccacccgggctcagcacctgacttgtctctccaggtgccttacagcattgtgggctggctggagaaaaacaaggatcccctgaatgagaccgtggtccccatcttccagaagtcacagaataggctcctggcgactctctatgagaattatgcgggctcctgctccagtgagtatggagggacaagatctccactctgacaggggcccacagagcgacattccctggagtgaccaggccccttgtctctattagctgagccccccaagtctggggtgaaagagaagcgtaagaaggcagcatcgttccagacggtgtcccagctgcacaaggtaaggccccatctgggagacagaccctccctcttggcagcctccagccccgtccttcaccccctgccctgtcccctgtgccttgggcgggcggctgttaagacttgcagtgatgtttaactcctctccacgtgaacatcacagcaagtctgtgctgcttcccgtccctacgctgcctgggcagggtttgtggggaaggggtgggagccctggggctctgggagggacggggatttggcagggaagtgaagactttggtggtggtgatgggagacagcgaagggtctcccatcaccagaatgagagtgaaagagcaaaagtgcagggcacttagggccctgctcccgtctcggtcctgaccactgcggcatccaattctggttctctgccccctttgtgcctttccctcactcttccccactgccaggagaacctcaacaagctgatgaccaacctgcgggccacacagccccacttcgtccgctgcattgtccccaacgagaacaaaaccccaggtagtcacccagggctggcctggctggggccgggaggcatcatgggaaggtgacagggcagaggccgggaggctgagtacatcttccccctcacctcgcagggtctccactgctgctttttctctggggcctgcgggtgtgcctgttgacctctgaccttttcccctctcacgtccaggggtcatggatgccttcttggtgctacaccagctgcgctgcaatggggtcctggaggggatccggatctgccgccaagggttccccaacaggttgctctacaccgacttccggcagcggtgggtgaccccttccccctgcctgctgctccaggtggaggcctgaggggctgggcaggacacacatatcagagcccaacagacggtcccctgtctggagggggaagcagggactgtgaggggcctggccaggtatcccagcaagacatgggggtggctcagacctggccggggacttggggagaagtgaataggcttggggcaaatagtggaggtggagcctacaggcctcgctgataagctggacatggaattctggatgcagaaaagacgaatgatttctagttttgggagtgagcaacctgggagctaccagtggtagatttactgagctacaaaaacagggttttttgatttggaggagaggtgaagggatactggtttgagctctgttttgcgtgtatcaggtttgaaatgcctccagcagacatcctagaaaagtcatgggggagattgggattatcaatctggagctcagggcagcgggcagaaaggatgcagatttgggagttgaacgagaatcatgtggacgaggcttcatgagacacctggcacatagcaagcacctgggcagtgctgccagctcctccccgttccctcaatgggcaacaagcatccatcgttccttctccctccagaagtcatggtgtcatccacactatcctttgtaaacagaggttcacacagataccatacacgcacacacacgcatggtgctgtgaccttgttttttctaacagtctggcctggagatcgttccttatccccaggcgtatgcctgccatcgtcatccgtttttcttggctgtgaaacatctcacagtctggtggactgcatgctttgtttaatgagtccccctcatgaggggccttcacagcgtggctgtagcccacctgacccacacagccctgtgcatgtgtccacttagaagtgggcaggctgggagccctggctcttttgcattagaatttccccccaaatgggctgggcgcggtggctaacgcctgtaatcccagcactttgggaggccgaggcaggcggatcacgaggtcaggagatcgagaccatcctggctaacacggtgaaaccccatctctactaaaaatataaaaaaattagccgggcgtggtggcgggagcctgtagtcccagctactcgggaggctgaggcaggagaatggcctgaacccgggaggcagagcttgcagtgagcagagatcgtgccactgcactccagcctgggcgacagagcgagactccgtctcaaaaaaaaaaaaaaaaaagaattttcccccaaatgtttcttcagtgatagggtacagcatgtcaccttctactaatattttttgcctttaaaaaaattttaaaaatagtgcatgccttctgtaaaaagcctctttaaaaacttaatgaatgcatttaaaatccccccaaggttgtgtttttttttttttttttgagacggagtcttgctctgtcacccaggctggagtgcagtggcaggatcttggctcactgcaacctctgccttctgaggttcaagcgattctgcaattcttctgcctcagcctcccgagtagctgggattacaggcgcccgccaccatgccccactaatttttgtgtttttagtagagatagggtttcaccatgttgcccacgctggtcttgaactcctgggctcaagcaatccacccgccttggcttcccaaagtgttgtgattatgggcgtgagccaccgcacccagccaaccccccagggattttaagtggagtgtccctagtgtcccagtgtggtgacgcatccctggcccccttgtttggcatgtgccctgctggaacctctgcaccagcctcggagaggcccaggaacgagtcccctgctacccacacgagcctcctcagtccctgacttccccattctcagtggcctgtgccccatacccagccctctcctgaccagctctgccctcctttcccaggtaccgtatcctgaaccccagtgccatcccggatgacaccttcatggacagcaggaaggccacagagaaactgctgggctcgctggacttggatcacacccagtaccagtttggccacaccaaggtcggggcactgtgggatcagggctggccatggctgtggcggtcacactgggcagggttcatgcggatggttgggggttaccctggctgtctacctctccgcccccaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcaggtgggtgtgggaaggaggctggggacagggtgtgtcccctgcctctcagctcccagacccactggctctcccaaccctaacatgctgccctgtagtcagatcagcccctgtggctggttggggcaaggttctgttctgtgtcccccagcctccatttccccacctcaaaaaacggggtacggcacttgcctctccatttcaggacatcagcgtgtggcccggaggggtagcgatggcacccagtgtcttccaagactcttgcgggccgggccccaggcaagatactttctctgcattatcctggttaaagcgctgacggtcctgagaaacaggcgctgtgatggcctccactcagcagaagggtgcccgtgtcagagatccagagctagctggcacgtcagcccaggccgctgactccagagccccgtggcttaacagccctggtgtcttccgggaattgcagaggccaccaggacatggggggctcatgagccccttcactggaggcaggcctgtgggactgtgggcctcccctcaccctcacctataaagcagagctattaggagctactccatgaggctgctgggaaggcaaaacaagtgaactgtgctgagtgtcaccatttgtgacgggcagcactgagccaccttcacagcttggctgcccctccctagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgtgagtcagggttccccttgtgaccgggcgtccccagccccgagtacccctggctgctctgagggatagtacagcgagacccatggggctcaggccttatgtctctctgttccaaagatgccatgagatgaggcctccatgtcccagcctcaccaccccaaggcctcgtctggcacgtttcctggcactctcccctcgtgccaccttggcctcccgctaaagcagaggaaccccagctccccagctctcccctccctgcaatccctgaaaccaaacagacccatgctctcttctctggttaagggccatgggaacccaggtggcaggtaacagggtgatagccagagagcacagatcaaaggtctggaatctccccaggtccacagagcaagctttcctgccttcggcacatggctttgtgtatcaattgtgtgccaggctcaggctagtgcaggaggaacgttggtgggaagacagagatggccctgtggtcacaaaactcacctgctagtgcaggagactgtgacgcagctggacagtaaggaaatggggggtaaggatacctgagcccttccagggactgcctccaggagcccgtccgtggctgtgcagaggctgctgctgctcaccctgcccctcggaaggcctcagcccaacagcggggcagtgagcagcgggcttccctctcagaacccttgtttgggcctcactctgggccgccccgcacttctaactttcccctcttaatgctctggtgtgtccctctgcgctattgcccttccatgcccaagagcgagtcaagacattcctgagttctcagagcacagccaaactttgctacagaggcagtttcctctccagggcctggcctggtgtctctctgctggtttacctggccctcccccaacctggccccgttccgtgtgccctccaggagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctgaagctgacactggccaaagctgagaaggagaagcaagccactgagaacaaggtgtgggccgggccagctgtggggaagggccctgagccaggggccagctttggggccaggtggctgcaggtcccaccccggctctgctaagcctctgctttctggccctgggcatgtcactgcctttcctgggcctcagtttctttatctgtcaagtggggttagcagcacttaccccattagggtaggtggtgatgtgtgtaattggcctttactgagcacacgctcctaggccttgcacacggtaggtgtttagcacatgctggcaatcctcatccatcccggagtgcaagccccttgagggcaggaactccatgtccccagctcggcatcccgcaggtgacttctgcccttgagccctcgtgatggcccctgtggttcccagtgctggaggagggactccattacacaggagggaaagtgaggcaggggtaggcagcttaggttctcacaggtgctcactgaggaagccgggactaggaggcagctgccctgagcacatgctaatactgcacatggctggcatctgtggatttctcaccaggccaggtgtggtgctgagcactgcgggtgcatccactcgtgaatcctcattacaaccccatgaggagggtccttccctcaggcagaagcggtggaggctcggagtcaagtgacttgcctgagtcccatagctggaaggggcacttgctctgacctggtgtggtgtggtggccgctcagagtgcggggaagggcgtccccattctggccctggccctggcacaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgaccaaggccaagctccggctggagcaacaggtggaggacgtgagtcagggccaccccgagactgggtggcggggccggggtgccggctggcttgggccatggctgacccctgctgtgcctgctctgcagctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagtaggtgtggtggggcagcaggtgggggccttctgagcctgcacctggcccttgttcccttctggattcttgtggttcctgcggcattgcagaggttaagggtgggggttgacagatggggcactggggtgcaggggtagtgtcttgccctccctgtactgagggccctagccagggtccagggctgaggcctcagggcccagtgcagcaggtgcatggggtgaggtccctcagggcctgaaggggactggggggcgttatggggtcccaggcgggtgggtgggagttaaggcctgtgctggccacccactctgtggctcccaggaaggactccgagctgagccagctgagcctgcgggtggaagacgagcagctcttgggggcccagatgcagaagaagatcaaggagctgcaggtgcgtggggatcgggtgggtgaggcctggggtcagaggcccacagaggtgacagctgccccacgtgcccaccccaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggtgtccgtgccttcctcaccccatacccaccctgactttaaaccaatcccgatcccagcagccaatactgttcccacaccagcctccacccagtaccttatcctgagccctgacctcttcacctggtacacaaccctcatttctcagcctcctaccagtcctgaccttaagccgtgactcccaagccctgttccctgactccaggtcatttctgatccagcatctacttccagcctcagacccttgaaccagcagtagttgtgaccctagcccttgactcctgaactctgacttaatacctgtcctctcttcctgtcctgaaccccagcaccctagccttaacccctgacctttctaccacataatcctgacagctgacctctgaccattgtccccaggtgactccgcagctaccatcccaactctcaccctgacccactgccctgggactggcccagccctgtcagttctgacacctgttaagcccagcagtagaatctctttccctgactttgaacttggggctctgctctccctttgattcctgggcccacatctagcttaccagtctctgatcccagatcctgccatctgatgcacaaacttgttctgacatctaactcctgacccctgactcccaacctgggatcctaggccagtgcagagaagctgtgccggacctatgaggatcagctaagcgaggccaagatcaaggtggaggagctgcagcggcagctggcggacgcaagcacgcagcgtgggcgactacagacggaaagcggtgaggctggggctcagctggccacaccaggcagggctttggtgcagccctcaccagcctgacctgtccgctcgcctctttgcctgcaggggagctgagtcgcctgctagaggagaaggagtgtctgatcagtcagctgagccgtggaaaggccctggccgcccaaagcctggaagagttgcggcgccagctagaggaggaaagcaaggtgggctggcaccggtgaccatggagtgggcaggtgggcaccagagccactgggctgcactaacgctgaggtcactggtgtccctgcaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaagtgagtgctttgctggccaggccactgccatgcagagctttatgcctgtgcctgagccccgctgagggtgggtgaagggagctgctggggctgttctccctccttccatggtccacaccttgtctggttccatggcctagaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcagggtaggacctgccacacgccagggccagggtgctgccctggggtcggagcaactttgagttatgggggtgccctggtggggccaccctggaatcaggggtgagtggagtgacctgggtgggagtacaagccatgggggtggcctctcagcaccctgtccactgcagaggagatcagcgacctcacagaccaggtgagtctcagtgggaagagcatccaggaactggagaaaaccaagaaggcgctggaaggcgagaagagtgagatccaggctgcactggaggaggcagaggtcaggggctggctgcaggggtgggtggacactgacctgctgctccactggccatcccccccccccaccctaccctgcctgctctgtatccacagggggccctggagctggaggagaccaagacgctgcggatccagctggagctctcccaggtcaaagcagaagtggaccggaagctggcagagaaagacgaggagtgcgctaacctgaggtgtgtccatccttctcccgtccccacctcccgagagcagaaggggagggaagcagtgtgtactctgctctctagtctgtccctcccatgggactttgaggtccgggttgctgtctccattctagctgtgaacctcggagatgctaaaggacttgcccaaagtcacacagtgggggtggagccagtcagtccacctctgtctgcctgggcctcactcttgtccatgaacttgctctgatgggccacaggcagtcacaagagactttaaatcggggaggggtgactcatttgttctcaaaatgggttcgtttccaacggtccttgggcatttgtaaggacaggtatgcccttacgagaccccctttcatgccaccctcctcccataggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcaggtggggacaggagtccctggggacagagcaggtgcaggcctgctggctggctggctctgagactcctcttcccctcagaacacaggcctcctaaaccagaagaagaagctggaggcggacttggcccagctgagcggggaggtggaggaggctgcacaggagaggcgggaggctgaggagaaggccaaaaaggccatcactgatgtgaggctgggcaagggctgtggggagcctgggacagaattgcagagggacttccctgaggctgggcacctgaccagctcctcctccccaacaggcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtgtgtgcagcccctctagtccttggcgcaggcagggtgggtgacccaggggtgggcttggcatcaggctgtccccctgcctgcaggtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggtgagtgcgctggggcctggacacctggaccgggcaccccagctctgccccagggtctgtggccaggtgaggcatcagcagcagctccaccctccaaggtcagtgacccagagggaagagagaagcttctaacatctctggggagatcagacctagctccttctcatggaacagaccccatgtgctttcccctggccaaggctggggctgcctctgaggggtggggcaggcacaaaaaggcacatgaagttggtgcgtcccaacttccttattcccgctgtggtattggtgaggatggacagtggcaataggaacaaagttgagaaccaggaggagctagctcccttcttggactggggcagggaccagaataagcatctcagtcacccaagcggaaccaaggccctgtgtgtgcccccaggagcagcaggccaacaccaacctggccaagtatcgcaaggcccagcacgagctggatgatgcggaggagcgggcagacatggcggaaacccaggccaacaagctgcgggcacggacccgggacgccctgggccccaaggtgaggagtggcaggggcattgctctctgtgcagggggactgtgggggctgacaggtagtactgctcactcagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccatttaattggtttatttgctgttaataaattggcaacacaaggaagggccccatgtccaggctcaggcaggagcggctgcctcaggcagaggcagggcaggcacagctgccccgtgccccaagggatggagggaaaggcccctcacttctgggagaacccccttggatgaacacagcggccaatgagcaaacagaaccagaggagctacaggaaaatgaggcagaggggcaggcttgggggaaggcagcattctctggtacccaccacccctgcccagggctcagaagcctttgcctgggtccaaaggccagggacaagggaggcttggctcacagatggggggtgggggtcacccatatcttcctccccactctgggactgactgacagccaagaaaccggcaggagctcacacagagctaatgctaaatgtcctcttacctctgggtggccctgggccccagggttctgaaggaaaggtgggcatggtaccctgtcctcattatggggactgaggctctccatgacctagggccctcagacccagggggaccaagggcttctaggacttccctcccaccaagcctgtacccaaagacctggggcaggcagagagcagcagggaggaacgggaacagggcagggcgtgtggcatcgtacccacgctcacccacactggcccagcagcctcccgaggcctggcccaaggtcactcctcagtgaagtccctgtctatgtccatgtagggctcctcaatgtagctaacgagagcagagggtgactgccggtccgggttcaacaggatggacactgtctccttccagtatgagaagctgatgcaggagctctgggcaaagagggaggggctggggggcgcctggaggacccaggtcaagcccagcaccgggacacccctctgagaggccctgggtccgcggcccacccatcacccccttgagggtggggcactcacgttctctaggcaggtgctgtccttgtccttgtgcaggtagtgctgctgccagaagcgcagcaggttgtggaagttgttgagcaggaagccggggtacttcttgctgtgctccatccgctgcagcagccgcaggtacaggggcagccgctctttccgtcgggccagcatcaggatcaccaggctggtgttgaggcagctgacgttctcctgcaaggccacaggcccacagggtcaggggctggtgggagccccagtggcccctggtgaacctgggtagccatcaggcagggaggagagtggccccaggcctcgggccacccacagagctctccctgcacagaggtgagataggactgggggaagggggcccccagcagccccagtttcctgactgagcaccttcctcttccccacgcccacctcccaccccacctgaggcaacaacacctgtccctgtccagacctgggctcaagcatcactccttccggaaggtccgtcccaggcagggctgggtgcgtgtgttggggcggttatcccgcttcagaagtgccattcagcactagcctgcgcgcctcggtggggaaagagttctgccccactcaccatgcactcccacctggtgcttcacctcagaacggaaccaaagaccacctctgagaggtgctaagatcaccctcactctagaaaagaggggcaggaggctcagagaagggaaggctgcatgactattcagtgagggagttgggcagcctcaggtccgattccaaagcccagcagggcagaaggtgtgagggacgtggacatgggggaggcggggagagcactggcctgcaagtcagcctgtgacctgagggcacttgcgagccctccttccttaggccctgtctgtacaatgggacactgattcctcctgagcacagtcctcagaagagctgggtctccagagacgcacttctggagtgggggacagaaacctgctgggcaccaggacaaaggaagtggtttccaatcgaccttccctgctgtgtgtctgccggggcctctcacctgggtcagcgtctgcacgtggatgatgttgatgaggcggaagaggaaggacatctgcgtgggcacctgggatatgtaggcgagcaggcggcattcagacagtacctcggcaactgtggagggaggcaggggtgcagcaggtcaggcttaggcccagtggctgggtcgcccaggcctttcgtggagccccgcttgggtcctgactctgaagctaggagctcatcatcaaaacagcttcaacgaaagctgactgtggcagaaagaaggacctccagctgtcctgctaccaggcaaagccatgttctcagagtgcccaggagcaccccacctcatcctccagaaccaagctcagggcagctctccctcagccctccccagactggctccagacccgtgccctccatatcacacacagaagagttccctccacaggaagatggatccatgacgctgcattaagaaaaacaacgcaaaagttccactccttctgcagaggtcctagcgcaactggttttccacaccagctctcaggtgagtccggcccagtgctgagaccacaaggcacaggttctgctccgtccactagtgtcggagcaactgcttcccgcacaactgggaggcagggcaataaccgaaggtaccaaaatctgtgtggctgttcccctgaaacagaccctctggggcagaaaaaggaagcaaacggctaaattaccaacaaccgggatacttcttgctatcaatgacagtgaccgtgacaaggaacaagtgcctgactttttgggggtgtgggggggtcacaaaccctcaggagaatctgctggatgccacaagccctctcctaggaaaaaaaggaaacgcgtgcgcatacacatggaagtgcgttagcaagtccaggagggttcagatgcctgctgcaccacagggcacctgcgatgccacgcacagcacactgaggacgagggggccaactcatcgtgccaggcaataccagcccagaagaggaaggtctttttctggttttctttgcatcttgctagcaacaatggattttcaccttattaaagtgttgaacaaggcagcaaagccaattgccctggaagccgccaccttgaggccggccacgtgggcatctggtgcagctccctcagtcattcttgtctccctgctggagacagggtgtctgatgccagcattcttaccctgcatgacttgccttgacagcctgcctttcatgtacctttcatatccacctggttttcaaatcggtccagggacagagtgacacagcgcaccagcatgttggagtccaccagggagctgttgatctgcttcaggaatacctggaactatacagaaaccaagctcacagcaggcagtgggctgctggccaggtatggccatggcccggggggatagtcactacaaggggcatcagcgacctctaccagccccactgcttcagataggaagacagaggctcagataagctgagggacctcccctcaccacccaggtactaagaggcactccccggaattcagcacagatccgacactctctccagtggttttacgctcaagggtgctggattcctttaatttttacttttaattttacttcagctagcctgagctgggtttctgtcacacacactcggtgagcctaacacaccaggcccagtccctccctacagcggctcccaccgtggcacccaccatgctgcgtcacggcaggcgcacaagccacccattcccaccctcactccctacccacaagcagccccggttttcatccctgcattcccagggtctagcacaaagccagacagagcaggttccaatgaatgtttgccaaagactgcccagactcccccgtcgtctctaacgtaaaacctgtgcctaaagcctggcagaccaggactccaggtgaacttctggacaacccagcacactccacagagccctgggttaactttacctttgcatcggtgttgatatatttattgaatctcttgaatgcatcaacgttgaacttcatcagctcccccaggaggtcaaagtaactctggagcacatcccttgacttacactcgctgtccacaatgcagtaaaggatgtgctgggtgaggagggacagggtgaaggtgtcaacgtggctgcccccaccagggcctggcatggagctcagaccatgcattggctttgagcaagcatcctggggatggaactggcaacactgtctagattcttgtctgaggatgctggtggctccaaggacaggaccaggcctgacagacctcaccaggaggtggagcagactgggaatgcagcacaatctctcccctgcccagggcgtacagctgaagcctgtgacctgctctgtggtcaccaagatggccggggtgctcagctcctaggtgaggggagctgtcatcaccaggtctaaaacacaggccactgcctaagcactgaggtcattcaagtaaatgaaggacagaatttaaaagcaaaggacacattttgaccccatggtttgtctttgtgtttatgaacgaaattgtttaaatagagtttacaccaaaatactgagttttcatcaagagaataaagccaatttactcctttataaagttttctacattttcttgaagttacattgatttggatcaattcttttccacatggattttataattcgtgggtcagtttcttgtccatatgaaaaaatctgaaagaccaattataactttggccattctgctctaagttttactttttctgaagaccattattcaataaaggaaaattaacttttagtacaaaatatcttcagggtcaaaatgccttgctgggtaaccaaactgtcaccctcctgcatggcctggccaccctctaaacctgtcaccccgtaagcacccatggggaacccacagttggaaacccagggcaaaatctaaggcagcctgcacaggcatttggaagtcacgagatctgctctgctcctgatgaactgtttggggctcaggacaggacacagcaacgcgtgggctggggggagacggaacccaagacactggctgctccagatcatacctccaagaggcctcgcttcagcaggaacatctggtctgcataggaggtggtccctcggaggaaactctccacagcccgagcttgccaaaacctgcgacccaaatactggctcaggtggctaaggctgccctcttccggcccatgttcagttctccaaggggttgggagatgtttgttgccttttcatgtactcaacatttactgaacatctaccaagcatcaggcttcatcctgggcctggggacacagcagtgcccccatcctcacagagagccagctcagtggagaagtcttctatctgggtctgtctggaaggggctgtgtcacagaaagggtaacatctgggatcgaagggctggctcctgcgagcccccgtgaaacatactctaggccttgccctttcacaagaatgggaggacgtgcaattgaggggccaggaatgtgtgtgggaagcggacgaacacatgcagacaggccactgggctcacagacgatgggctggcctagggaagtagtggttgatgctgaccgagggacccagagggcacagcgggtatccacgacagggagtttggacaaggcactgaagtgacaaaggcccatgtgggcatgaagcctcctgacagctcacgcccggccctgatggaactctacctgtccactgacttcaagactcatcttagatgtatctaaggacctcagagaaggtctccctgtattcacccagcccccagccctagcagcggaagaggctttcctttgctgctatagctcctgggccaaccctggctccattccttcccacactgcattgaaacagcacagctctagggaattcatggcagggcccgtatcctagttctctcccacccataaggcaccagcacagaacaggtgcttggtgaatgctcggtcactgtgggctgcagaagaagctctcacatacctgtcgagtcaaaactacacaagatggcagtcaaaccacctctccccaacagtaattgtgcttcaggaggcatggacgctggtgactaaaggaggtattcctaacctcctgagaaacacctggctctgcagccccgcagaatcggcaggtacttttccccagactcacctgaaagacgactctgctggctccttcttcatgacctgcagcagacgagttaataagcccctcttcccatcacacaccaaactcctgaaatagaagagagatattggtgacagatctgagaggctgacaggggccctggggatgggtcattctgctggcttaggcggtgaaaaaccatggggacatttccaagtctgcaggatgccttcctgctccaactgggtccagagccccggagacccctgcagccacagaattaaactgccaagtgcattcccaccacatctcaggccagctttccttcccaggccagaaacatatccagaatcagacatggcttagaactgccagaggagagctgtttataccaaaagtgtgttgaaacaggtcatgccagtctgccagatggggaaagactctgccaatagggtgaggcccagcgtactccgtgcctgaggttcacttccagctggccttgggcaagtgtccacaactccaagcctcagcttcccagtctatgaagcaaaggcaggagatgaggaaatgactctggccccgtcatgggggaaggaagacggccaggcacgcaggggtctgggcccttcaaacagagcagctctgctgtgatccactgcagacatcagggcaggactgggtacaattttatttgaatgaagagttctgctaccttagaaaaaaaagattgggaggccaggagaggtggttcacacctgtaatccctggactttgggaggctcacttgaggccaggagttcgagaccagcctgggcaacatagtgagaccccatctctacaaaaaaaaagtaaaaacactagctgggaatggtggcgcacacctgtagtcccagctactcgggcggctgaggcaggagaatcacttgagctcagaagtttgtggctgcagtgagctataacaccactgctctgcagcctgagagaaagagcaagaccttgtgtctaaaaaacaaaacaaaacaaacaaacaaaaaaggttgggaaatcatggctcttgttggataaagtccactgtattctgacgcctgtgagactagccccccactgcctggctccaggtgaggcaaacctaacccaggtaatgcaacctaacacttggcagcaggtaagaggcttctgtctgtcctgcttggctgcagatgccaccaggcaagaaaggagcacataagcaaaggggctgaatgcacgagacaaggcggtggggcagtgcggagcacacatgacttctggcaggtgacctctctgaggctcacctcatctgtcaagtgcaggtactgatggggctcccctcctagggctgctgtgaggctccaatgagaaaatgcaggtgacatgaatacaatgcctggcacacaggagccctcaggacactgtagctgcatgtgagagaggacacgcgtgcatacctggatgtgctcaccggtgagcccccggggaacgtgggcagccgggatgggctgagggaaaagctgcacccctgcactcacctgtcggtgttgaggacagcttccacctcagggatgttggccttgagagagatggcactgagttcattcagctcctggttgttgagtaacaagtacttgttcctgaaacaaaatgggttggaggaggtaaaggacaggaactggggctgctgggtcagcaccaggctagtgtagggagtctcctgcccacttcctgtggacagaatctgagaagccaccaggcactttcctctagcacctctcactccagccagcacctgcaggagggaactctgggctctcaggcagtggaatctctccctggccccacccccatccccgacccctgcctgccacattcatcgacaaggccccttccctcagcagctctgggcctttctctttgcctacatttccacttgttttctcaaaggcaccaacacctcaacaggtccaatcacactcaagcctggccctgctgcagcagtcccaccaagcaccacggtcacacatcacacagaggcctggttaactgtgacacttcccccgacttgccatccaggcctgtcactgctgggtcctgtgttcccaggacaccagctccctttactaaaaggtatcccacaggaactgagtcatcacacggtgccaaaagtgatcttcagaatcaggactctgatcctgtcactcccggtgaaaacacttccacagcttcccactgcatttagaacagacatttcctgacttaggaggaggttatgtcctgataaacccatcgtatttgaaaatgccgttaagttgaaaacatattgaggccgggcgcggtggttcacgtctgtaatcccagcactttggaaggtccaggcgggtggatcacgaggtcaggagttcgagaccagcctggccaacgtggcgaaaccccatctctactaaaaatataaaaaattagctgggcgtggtggcacacgcctataatcctagctactcaggaggctgaggtagaattgcttgaacccagaaggtggaggttgcagtgagccaagatcatgccactgcactccagcctgggcaatagagcaagattccgtcttgaaaaaaagaaaaagaaagaaaacacatttaatatatctaacccactgaacctcctagcttagcctagcctacctggaatgtgctcagaacactgacttcagcctacagttggccataatcactggcaacacggcaggcacagcacagagtactggttgtctaccttggtgatcgtgtagctggtcaccatttttcttgaaatacattctgagctgcagctgcagctcagtgcccagcattgcaagagtattgaactgtttatcatgagcccaggaaaagatcaaaattcaaaattctacttctgtaccattgtgaagttgaaaaattctaagtggaccatctgtatataaaatccaggcctgtgactgtgacccacaacaccctgtgactgtgacccacaacgtcctgtgcagcccagcccagagccaagcccacatcactcccatcagctggccacaatggtcttccctcgttcaggggcttctggctagaacacacaccctctcacatgcctgttcactcaattcactacaagctgacacttcaggtcttggctggcaagccacttctgcaggggagagttcctgagtgtcctctggccagtcctggaccctgtcaaatgtctctcacagaccccgttcctctcctcctgaataccatctccacttatcactaatgctcaacggtggaatccttggatgaacaactgtctctgttttcagactctgcccttcatgagagcaggggccatggctgtttgcattcatcctgatatcccacagagtactcagactgaagagtctgatgaaagccagagactcacttcctcagggaaaacagcacagttccataacatatgtggtgccatttttcagaaggttaacatgcttcctggagcccttctatggctttcagccggaaaacctctcacagaggatgggtgcatatgatggaggtgccctggggccacagctgtctccaggcatgttctgttagctcaaatgcaaggtttttaaaatatttaaaccaacatttaaaatcaggacctttcacataaatcttaatttctgcctttgcttggcagaaaaaatcagaagttatgcaacagtgggcccagtttcctgtgcacacgcagctggctggagctgagctcactgaaattcttgttcactaaggtccccacatcacctccccaatgccaaggtcaagggtcagctgctagtcacccccttcctgcactgttttccttacagcagagagtaattttccttgtacattctccatcgaaggttaaaaaataaatgagcgcagaatgtctttcaagaaaaatgggagcacacctccttgtggagggaagaatcctccagctgctcagtaagcagtcggctttgcctgtctgaagttcctgccggcccctgggaatagccacgctgtccactcttgctttagaggggcagtaggttgagaaatccattgattccaaaggtagtaaggggccaacgacttccatactcagttcctggggtggctatgagggttagaagaaagcttggggcagtgcctgccataaggaagtctggaaagacgggaggtccgactgcagtgtcacacctgctaacactgaggggacagtgggcttccaccagctccagggcctcctctcgagctgaggtcagggaccagacaaggagatcgaggccttccgaagacagcccaacaactctccttgcagggacactcttgtacttactcgtggtggtcactgaagctctgaagaagcctcaaaaactgtatcttcaaggtgatgtcctgaaacacatgcacagcctcaatgttaggaccacagccacaaggttccaaaataacacaagcagacactctggtgggagcctgcttctctaagcctctgtcctcatgtaccatgaggacttttctttagttagaaaaccatctgttcacttccacatctgatcaacagcagattaagctaatgtggcccccttcctgctaaaaacatgccatcacactcaataaaaaataaggcggggcgtggtggttacacctgtaatcacagcactttgggaggccgaggcgggcagatcgcttgaggtcaggagcttgagaccagcctgggcaacatggcaaaccctgtctctactaaaaatacaaaaattagccaggcatagttgctgcgcctgtaattctggctactcaggaggctgaggcaggagaatcacttgaacctgggaggcggaagttgcagtgagccgagatcgcaccactgactgcactccagcctgggtgatggagactctgtcccaaaaatccaaccaaccaacaaacaaaacaacacgtgtggggaggagcgggggaagtccataggagttagaaatgaagaaaggaccgaggagtttggaatagtgagccaaggaactgatactcagcagctgtgggcagtgtggagaggtggagacaagacctagtcacactaaggcttgggttttaatgccctgcagggactagacagggtgtcaggtcccagtaaagcctggggagcatgtacacttggtgaaagaagggttagaaaggcctgacccaccagcccagggagcctggctctgccatggtgctgctggtgggtgaagggggccctcccaagagcagcagaaaccctgggctcatacgactggggcagtagggccaagacattaaataagaaaactggccctgggacagctgccagacaaaagcaaaagtgccctgtagaaatgcctccagggctgaggctacacaggtatccaagggggaaactaaccccactgacctcaagtgatctgcccgccttggcctctcaaagtgctgggattacgggtgtgagccaccatgcccgggagcacgtttctataggtggatgaaaattacaataggataaaacagcaaataaggaaaagcaggctgctagctcatgcagtgggcagccccctccctgcctggagtgaaatgagatccccatcacagagattacaaggggaagtggctagagggcctcaggcagaatttttttttttttttttttttgagacacagtctcactctgttgcccaggctggagtgcagtggcgtgatctcagctcactgcaacctctgcctcctgggttcaagcaattctggtggccgctccacagacattacaaaacacgaggcaacactccaccctgaggtctgaagacccaaacacaagcattagtgccccatgagcaatcgaaagagaccttaagaaagtattttaaaaatgattaaaaacagaatatgcagcagaaaaaagatattaacatcatggctaagcagtttccgaattgagccagacagaacatctagaaatgcaaaatatatttgcttgaaattaaaaactcaaatgataaagcagaagacaggtcgctgagggaagtccccagagtgcagtgaagagaagagggccccatggcaccaggccgatggctgggtggcacttttaggtcccagagcactttccttctcatgctggtaggcagggtgccgactagccggggggccaataggggaaagagtattatccttcttttgcaagaaaacagaggctcagagattcagtgattcattcaagctcttccaacaagccttccaatgtcctgttcagagctctctcaaggggactgtgagagacacaagctaaaggagagtgcttgggctcaaaaaaccaaagccacctttttttgtatgagacagtgtctttgctctgtcacccaggccggatgtgcagtggcttgatcttagttcactgcaacctctacctcccgggttcaagtgattctcccacctcagcctcctgagtagcagggattacaggtgccccaccaacatgcctggctaatttttgtatttttagtagagacggggtttcaccatgttggccaggctggtctcgaactcctgacctcaagtgatctgcccgccttggcctttcaaactgctgggattacgggtgtgaccaccacgcccgggagcacggttctataggtggatgaaaattacaataggataaaacagcaaataaggaaaagcaggctgctagctcatgcagtgggcagcccctgcctggagtgaaatgagatccctatcacagagattacaaggggaagttggctagagggcctcaggcaggaactttttttttttttttttttgagacacagtctcactttgttacgcaggctggagtccagtggcgtgatctcagctcactgcaacctctgcctcctgggttcaagcaattctggtgcctcagcctcccgaagagttgggattacaggcacccaacaccatacctggccaatttttgtatttttagtgagagacgcaagtgtctctcacactagtgagacagggtttcaccatgttggccaggctggtctgtaactcttgacctcaagtgatctgcccgctcggcctcccaaagtgctgggattacaggcctgagtcactgtgcccagcctaggaagatcttaaaagggatttctgcataggttggggtggggagtggagttcactcagatcctactccaaggtagcttccaattaggggactataagatatgattttagtttctgctctactcccaaaggaaaaaaggtcaaagggtcagcagcaggtcttgaaacaactactccaagccagtgaggccccatctgtccccgggggtctcctgcttaccgggctacagtcacagttctggttgtgaccatggaggacaagggcagatgctgaatgcttcctccaaatcagtttgtcaaacaaattattaagtccagggatcagcttgaactctgcaatcattctgtgaacctgaatgggataggaaggaaaaagtattaagacaaatgtgcttgaaaaatctagcaaaacctcgtgctcagtacacacgataatgatattcaggacaagtatcagtactgtcagtaaggagggccagggtctgaagaaaacatccgtgtatcccctatgcccagcacacacaaacccactttctaactttgctcattaatgctcacaataatcctacaaggcataatgtccggtagttcctatcacagaagcatgagtttgggattcagagagtcctgcatatgattcaagagtcctttgggatgcaagagtcctgggtttgactcttagctttaccatgtgcaaactttgtaaccttaaacaaattccttaagatttgtctcctcgtattaacatcaaaatgttcctcatgctttgcactaggataaatttcagctgaaagtaagatacaattattaaaaaactctaagatctagaaaaatctctgcaaagaaaaaaaaatgatctaagagttggaaaagcctttctgaaggattataataaacctagaagctcaaaaagaagcttgttgacatcaaccacctaaacctttaaaaattctgtatggcaaaactcaagcaaagtcacaagccaaatatgacaaacagagaacatacattggcaattcatgccacaggcaaagaaattcctctataaggagtcctacaaatgtctctgatttttcactttttcagactgggaaagatgacaaagctttataagaccgtgttggtgacttgggcattgggtacattcacacgctgttggtgggagggcacactggtatgacctgcacagggaagagtgtttggcagtagctctaaaattgcaaatccataatccctttaaaccagcaattccactttaggaatttacactcagacagatccatataaacactaaatgatatatatttacaacactactcactatagcattatttgtaataccccaaaataaattatggtatgccactcaatgggatacaaggcaccagtaaaaaagaatcaaggtattttatatgtcgtgaactgaacaattgccgagagataatactgggaaagcaagtgtgctcatgctgtattactgattgtgtaaaaaaagaggaatacaattcgcctttgtaagcataaaaatgtctctagaaggatacactaataactggtaaaattagctgcttcatggaaccattagaatagaatgtcaaggatcagaggggagagaggcttcacttatactaatttatatcttttaaaacagaactgcaggaatgatttccctgttaaaatttgtttatataacataaggctattactagcccttctcggggctgttgtaaggatcgagtcagaaagcagatgtaaagctctgcacacagcaccagtgctcgcttattgctattttacaagggggagaagttcagcaagaccagcctgggtaaggtcagtgattgcaacggcacctaactcaggtgttcagatcttaagtctgcccctttctagcccactacaggtatgcatttatcttgggagaccagaagctgacaaagacatccctggcagcctccatttccatggacctcttccttcaacatattaggttgtgtaaaagtaattgcgatttttgccactgaaagtaatagaggtgactattctcttcctactagaaatcacagcctctggccagtgttaagactcataagcagcccagaatctgttagactgaggctgatgtaaaatgacacctgttctgccactcaggcctttactaaaacccagcctggatctaccttgccctgcttaactgggggtggggaggtacggctgacatctatggtgttcaccaagccatgtgccttcctgtctcactccaaagggccctaagccaggcccaggtcacacagctataaaatgttccaacaatggcccaaaaaaattcatccagtgcaattgcctcactgcacagactagaaacccaagcttaagagattaggggtgagtcacacagctgggaagagaggggccttctaaggcagacttggacctgaccctgggtctcctaagttcaggccagtgcttaggtttgaggtttctactacatcatttcccttttctcttaacaataccagcttctcggccgggcatggtggctcacgcctgttaatcccagcactttgggaggccaaggcgggcggatcacttgaggccaggagtttcagaccatcctggccaacatgatgaaaccctgtctctactaaaaatacaaaaattagctgggtgtggtggtgtgtgcctataaccccagctacttggagggctgaggcaagaggatcgcttgagctggggaggcagaggttgcagtgagccgaggtcatgtcactgcaccactccagcctgggtggcagagcaagactgtctcaaaaaaagaaaaaaaaaaaaaaaaaaaaaagaaagaaagaaaatagcagcttcttcatgtgtaaaatttgtaaaacaaattttacttgtagaatgcattattcctactctcaggtccagccccgtagcctgctctatagcaggatggtaggcaggtgggcgagatgaagtgccactctaccagaggaggcagcgggtacaggctcaggcatttatctctgcagtcagacagccctgggttcacaagatagctctgtgaccctgggcaacattctttgaacccaagtcccttgatagaaaaggcgatgggggacgatggagctgttgaaaaggctcagtgaggtactgtagaagctactcagggggcactaaaagaaacgactgctatatggatggttttcattagcaccagagggatgaaacttgacagcacatggggagcctttccagtcctgagatttcaatttggccaagattggtctgagaacttggcccaactgctcattaacgaggaggcctctttaaggaggaagccttctgtgaggcctggccaaggaaacccttccccttgctacccagtgtaggcaggatctgggaatccagatcctcacggtgcccggcacacagcagaaacccaggaaatgctgactgtgcaaatgagaacacgctagtgaaacagtggttttggggggccaggatttcaaggtcattagtggtcccttcccaaggaaccagcactgtaatcatacagtttaactcaagaccgcaacaactcatagcaacctggcaacaagaaggctcagggaacagagaactgctgtgagagggcagaaagaggagacagggcagcagagtttaaatcctggctctatccaggcctgtcccctgagcgcacagcccagtttatgccctggctttctcaagaatcgagtgtggggacacagagtcaccacctgttgtgtaacttactaaatacctgaaaattcaaacaactgtgaaagtgcctcgaaaaagtaatagcactcaatgcacagaagctgtccctacaattatttcacatataagcaactgcgaaagtgcctcaaaaaagtaatagcactcaatgcataaaagctgtccctaaaactattattttttattaaaaacatgttccgtattgaaggaagggacaccaatgctgtggctatcaccgtgggatctcatccagtgtcctggttttaaatacaaccatatgctgaggactcccaaagtgatacctccagccttgccatctccccaacaccaggtgtaggtaatcaatccaagtgtcaattctaacacacacctcaaatctaccttgtacaaaacacaactccccatcttcctccctaagcctgctcctccaccccttacctgctagtcttaaccacctcaatacctggcaaatccattctcctacttccttgggcgaaaaaccttgggagtcacccttaactcctctcctcactcttaagttcacatccaaaccatcagcaaatcctatctttcaaaacatatccagaatgcaaccacctcccaccagtcccaccatcaatgtgctggtcctagctgctatcatctcttggccctattatgagggcccctaatggtcgccctattcccttccttgctgtttccagtctttccaaaagcagtcagaggaatgacttctcacttcactcagagtaaaaaccaaagtctttaaaatggcctgtgacagcttgacatgacctggtccctgtgagccctcagccctcctctcctggctgtttgctccaggctgtcccgcgctgcctcactgttccagcaactatgcacactcctccccagggcactgccccctcccacctggtacactctttcattctcttctggacgttttcatcctcacttgtaaaatgggggtaactgcacctctgttgcccagacttgtgacagtccagtgtctgactcagaaagatgtggaaggactgctgagcctccagcctctcctgcccccatgcttggtttcctccctagaagggcgcggtctgcaggaaaaggctacttctcaatagtcttgaggagggccgcactgttccaagccctttttcctccactgtaggttatgggcccctcctcctccgtcttggaactacttcaaggctcagggaaccttgcacatctggagctccctgtacttgcccagttttcctaagcagacacagctctgggctctgtcccactgccctgagcccacatcaggttggcaactcctctagcatgtccacagggccaggcttgccagctttcaactctttagtcttcacctcacagaggcaactgcctgcttctgccctcagcaccaaccaagactgcctagaaacgctccatacagcaaggcacagtgaaaagactcccggttctggaatcagcctggtttccttataggtagaacagaaggagaaatacccctatgctttgccaggctaaagcgagagccattctaacagaaggcccagtggagcacctggcataccatgagcacccgggcagcacctgctccccgtgtcctgagacgctggagaggggcccacctggtttcgctgacgccccatcagcagcacgcagaggacatagagcacttccagtttgtacatgatctcatgcataatcttcattgactggggcagctgggttctggctgacgtgtgaggcaggccattctcctcagaagcccctggaggagggaacacaatggaggctgacacagccaccggagacaggattgagtcacagcttgtgaggaaacacgtttctgcccctcgaacctgctctgaacagacttgtagcatggccattcggctgggccatgagcccaaaacacagactctgaaagctgcaaaactccctccacaatcccaggagccaggtgagcgcagagactcggaaaaatggactctgcaatagttgtgcctcatcaactttaacataaagtaaaaatattcggacacagccaatacagtaacatgacccatccctccctgcttatgcccttctcctgccaccaaccagacccccaggaagtgcccaggcagatgtatgacagcaaattatggggaccgctcttcaagtcgcaaatggccctgcttacttggttcttctgctgagactccatgagggacactgctgaagcccaagagggattctttttgaagaattccccgttttttaaaagaagaaccatctaaatttttctaaggttcaactttctaaagcagactgggtatcacaactgatgctactgatgcagatgaacatattatctacaggcagattttcattttacccaatgtcattactgctaacatcaacagcagctaagtgatatttatgggacacttgatatgtgtcagacttgctggctttatgactttgggccagtcacctcctcactaggccttagactgctctgcagcagacagctagggttactgtgcagactgaatgggaacgtaagagaagcccagcatctgattcttaggaagcccccattcactcctagatcctttctttacttatttacagagtcttgctctgtcacccaggctggagtgcagtggcatgaccttggctcactgcaacttccgcttgctggtttcaagcaagtctcctgcctcagcctcccgagtagctgggactacaggcatgtgccaccacgcccagctaatttttctatttttagtagacatggggtttcaccatgttggccgggctggtcttgaactcctgacctcaagtgatctgcccgcctcagcctcccaaagtgctgggattacaggcgtgagccacggtgcccagcgtagatccctactattttaagagggcattggtcagagtcaggagaggctaggtgatcttagcagagtgacttcccttcagtttcctcattttaaaggtgaacagatgaatcagtaactgccaaggtcctctcaagttcctacaggaactgcttccctagaggccttttgcaaaggcctctatgtgttatagaggagtggttatcagatatattcaggtaaggctcatacagaaaacacagtgatactctttaaagtatcaagacagaagaccctaacttattccgactaggtgtggtggctcatgcctatgatcccaggactttgggaggccgaggcaggtggactgcttgagcctaggagtttgagaccagcctggacaatacagtgagacctcattgctataaaaaaatttaaaaaattagctgggcatggtggcatgcgcctgtagtcccagctactcaagagggagaggtggaaggatcgcttgagcctggaaggtgaaggttgcagtgaaccaacagagatcgtgccactgcactccagcctgggcgacagagctggactgtctcaaaaaaaaaaaaaaaagagagaatctaacttactctatcctacagacttggaactatctttccccgtcatgttaaaatcacaaccttggaagacgacaagctgctgaatgaagtgtgactgagacacagtgtgacacggtagttaagagcactgaccctgaagccagactactgggtttgaaccccattcactagccgggtggtcttcagtaaatcagtggacctctctgtgcttcagtatccatcctcctttgtaaaacagcaatactgacaaccatacctaccccttaatgttgtaaggagtagagggatatactgaaggtgcctggaacatagccccaagtaagcaacatacaattagaaactaaatagaagttaagttctcagaaaactgagtttttctgcgaatgcttgcttgttactttgtattctttttcatctccaagcttttaatgggaactaaacaggcaggaggcaaagacttaggaaaaatttactggagaaatttttaatttaagagattctatctactcatatttattctcctgtaccttgggcaaaaaactatagttactcaatttccatgttagcactccttggcccagcttccagaacagttaagtgtcagctaatctgtgaagtgaacctgaagaactatcacgcagaatcctgcctctgtcgtgcactgctgtgagaccttgcgtgcttggcatcctcggcacccagcccatggtgctctagggagtcctgcagggaaggatgtttatgcaagcagtgggcacagtgtggggcacacaagtcctactgagaaatgaacgtctgcgaagaaagagacagggcagcctgacccctctccaagtcaccaccaacttttggtgcctggcttgcgcaggcctgacaagactttctgtgataaatattttcaagaaacagtctccaaagcaatggccagagcttagcaacaaggtcagtcccaaggatgaggatgggaaaaccagctcacgaggcctgtgctcccctgagtctcttcagctctaccacaccgattggagcggtcaccactctctgtctgcactgcactgttttctgcggacatgcacactcacttttttttttttttaacagctttgaggtacaattcacataccatgcaattcacccatttagttaaccatggtatcgtgatttttaggacattcatagagttgtgcagccattaccacaatcaattttagaatatcttcatcaccccccaaaagcagccttgtactcactaccagtcacttcctatttcccaccaaactccttagctctaggcaaccatgaaactattttccatctctatgcaattgcctgttcaggacacttcatattaatgaactcatgcaatatgccatcttttgtgactgcttctttcacctagtacaatgttttcaaggtttatccatgttgtagcccctatcagcattcccttttattgctgaataatatccgctagtataaatatatcacattctggcttggtacagtggctcaggcctgtaattccggcactttggaagaccaagacgggaagatcatttgagtgcaggagtttgagaccagcttgggcaacacagcaagatcctgtctctttttattacaaaaaataaaaaaattagctgggcgtggtggtgtgcacctgtttccagctactcgggaggctgaggtagaaggatggctgagcctgggaggtcagggctgcaatgagctgtgatcacaccactgcactgtagcctaggtgacagagagagaccgtctcaaaaaaaaaaaaaaaaaaaaaaaaaaaaaattctgtttattcattaatcaggtgacagtcatttgcgttgtttccatattttggctgttatgaatatgctgtgatgaacatacctgaacaaatttttgtgtaacatatattttcatttctcttgggtatatacctgggagtaggatttctaggccctatgacataactgtatgttaaccctttgaggaactgctagactcttttctaaagtggctgcactattctacatgcccactaatagtgactgagggctctgatttctccatattcttgccaacccttattatccaccttttttgatgataaccattctagtgagtatgaagtactatatcattgtggggtttgttttttcctctatcatctagactacttaagtgcagtggcaggatcacagctcactgcagcattgaactctggacccaaacaatcctcccacctcagcctcccaagttgtcaggactatgggcacgtgccaccatgcctggctaaccgaaacaaaatttttttttgtagagatgaggtcttgctctgttgtttgagctggtcttgaacaatcctcctgccttggcctcccaaagtattgggattacaggtgccagccactgtgcctggcctcactgtggttttgatttgcatttccctgacggctaatgatggtgaacatttttcacgtgcttaataattatttatatatcttctttggagaaacatctattcagatcctttgtctatattttgaaatgggtttttttattattgttatgagagttctttatacattctagatacaaatcccttattagatatattatttgcaaagatgtcccaccctgccttacccacaaaaaacgttcttccattctgtgggttctcttttcactttcctcattgtgttttctgaagaacaaaaagttttaattttgatgaagtccaatttattatttatctggttgcttgtgcttcagatgtcattgtgtatgacagctaaattgttaaatccaaggtcatgaagctttatccttatgttttcttctaagggtttcacaggtttagctcttacatttaggtctttgacccttttaattttgtatatgacataaggcaggggatctaacttcattctttcgcatgtggacatcaaatggtcccaataccatttgttgaaaagactactactgtttccaccaatgaatggtcttggtacccactgaaaatcaattgatcataataagcatgagggtttatttctgaactctcaacaatattccattgatcaatatgtctatcctcaggccagcagcatagtgtctcgattgcagctttgtagtaagttttcaagtcaggatgtgagttgtcttaggttgttttttttttttgagacagagtcttgctgtcacccaggctggagtgcagtggcacaatcacaggttactgcagcctcaaactcctgggctcaagctaccctcccacctcagcctcttgagtagctgggactataggtgggtgtcacgaggcttgcctaatttttaaattttttatagagacaggggtctcactatgttacccaggctggcctcaaactcctgaggccaagtgatcttcctgcctcagcctcccaaagtgctgggattacaggcatgagtcactgtacccggcctagttcaagactgtttttgttaatccaagtctcctgcatttccacatgaactttaggatcagctactccatttgtgcaaagtagtcagctgagagttatgacagaaattgtgttgaatctgtaaggctgatctatagatcagaatgggactatcattatcttaacaatattaattttctgattcaaagacatgggatgtctttacatttatttagggtttaatttctttcaatgatgttttagaattctcagagtataagttttacacttaagttcctaagtattttatttttttgatcctattataaataaaattgttttcttaatttttggtttgttgattgctactctatagaaatactactcattttttaatattagccttgtattctgaacctttgttgaacctatttattagtttactggtttttatagtagattccttagatttttctacatataagatcatcccatctgtgaacagtttcactacttttctaatttgcatgcctttaatttctttttcttgcctaactgccctagccagaacctccaatacgatgctgaagagaagtggcaatggcactgccacttccagaaacgatcaggaactcgtcttgttcctgatcttagtggtagaagctttcaattttttgccattaggtatgtcagccatgggtttttgtagatgccctttaacaggctgaggaagttctctcctgagtttttgtttttaccatgaaagggtgttggattttgtcaaatgcttttttgctcctatggaaacgatcatgtggtttttgtcctttattctattaacacagtgtattacataaactgattttcaaatgttgaaccaaacttgcataaatccatttggtcatggtatacaatccttgtatgttgctatacttggtgtgctagtattttgttgaagatttttgcacctataatcataagagatactggtcttgtgatgtctttatctggttttggtatcatgataatatgacctcaaagagtaagttgggaactgttccttcctcttttattttctattagagtctggaaagtattggtgtgaattcttcttgaaacatttggtagaattaaccagtgaagccatgtgggccaggacttttctttgtgggcagtttttcattatttattcaatctcgttgttatacttcaggttttctatttcttcctgagttagctgcaatagtttgtgtcttttaacttgctcatttcatctaggttatttagtttattggcttatattgtttatagtattcccttagagtcctcttactttcttaaggttggttgtaacgtaccttctttcatttctaatttagtaatttgagcctttcttttttggtcagtgtggctaaaagtttgtcaactttgttgatctttttaaagattacctttaaaaaaatcacctttggttttacagattttctctactgtttttctattctctatctcaccagttttcactctaatcctattacttccttttccttttgagatgtttgttctttttccaatgacttaaggtagacgtttaggcaatttagatttatttaaaaatgtaggcatttatagctctaaagttccctctaagcacgctttagctgcatcccataagtttgatatatagtatcattttcatttgtctcaaaatatttccttttttttttttgatggaatctcactctgtcacccaggctgtagtgtgatctcggctcactgcaacctctgcctcgggggttcaagcaattttcctgcctggacctcctgaccttaagcgacccgcctcctcggcctcccaaagggctgggactacaggtgtgagccaccgcgcccggcctcaagacacttcctaattttgtttgtgatctcctgtttgacccactggttatttagaagtatactgcttaatttgcatgtatttattaatttcccaagtttgttatttatttctaactcaccccactgggatttgaggacatacttttgtacagttttaatccttttaaatttgctgaacttttttttaacagcctagcatatggtctgtcctggagaatgttcatgtgcacttgagaagaacgtgcattctgtagtagttgggtggagggttctacagttctctgttagtccttgttggtatacagtgttatttaagtcttctgtttccctgttgatcttctgcttagttttatccattattaaaagtagtatgttaaggtctccagctgttgtttttgaactactgctctcttccaatctgttagtttttgcttcatgtattttttgggggctgtttttggatgcatacatgtttataactgttgtatcttcttgatggtttcaccctgttattatcaaatatccctattttgctctgataacagtttttgttttaaagtctctccagcttttttggctgggtggtggtggctcatgcctgtaatcccagcactttgagaggccaaggcaggcagatcacctgaggccatctgagaccaacctggccaacatgctgaaaccccatctctactaaaaacacacacaaaaatgagctgggcgtgggctccccgcctgtaatcccaactacttgggaggctgaggcatcagaattgcttgaacccgggaggtggaggttgcagtgagctgatcgtgccactgcactccagcctgggtgacagagtgagactctgtccctccaactttttaaaagtacagcctctccagctttctcgtggatgctgcctgcatgatacatctttttctgtcctttactttcaacctattttatctctgaattgaaagtgtgttttctataggctgcatataactggatcttgttttctgatccaatataacaatctgtcttttgaatgaattgttaaatctattcacatttaatgttactattgataaggctggactgacttctgccatttaactttttgttttctgtatgtcttgtgtgtttttttgttcctctatatctcctttagtgtttcttttgattaatattttctagtataacattatatctccttcaattatttctttactatatttcccaagttactttctttttttttttttttttttttttttgagacagagtctcgctctgtcacccaggctggagtgcagtggcgcgatctcggttcactgcaagctccgcctcctgggttcacgccattctcctgcctcagcctccccagcagctgggactacaggcgcccgccaccacgcccagctaatttttttgtatttttagtagagacggggtttcaccacgttagccagggtggtctcgatctcctgacctcgtgatccgcccacctcagactcccaaagtgctgggattacaggcgtgagccaccgcgcccagccccaagttactttcttagaagttgctggctggcgcggtggctcatacccgtaatcccagcactttgggaggccaaggtgggtggaccacctgaggtcaggagatcgagaccagcctgactaacatggagaaaccccgtctctactaaaaatacaaaattagctgggcatggtggcacatgcctgtaatcccagctactagagaggctgaggtaggggaatcacttgaacccaggaggcggaggttgcggggagccaagatggtaccactgcacttcagcctgagtaacaagagcgaaactccatatcaaaaaaaaaaaaaaaaaaagaagttgcttaccacatacatcttaatcttttccagattttttttaaaaattagaaataaatatggaatgcatcaggaatttgcatgtcatccttgcacaggggccatgctaatctctgtactgttccaattttggaatatgtgttgctgaagcaagcattttcggatttattctaacttagagctccattccatcttcattctttttgtgctgtaattgtgcatattgtatctatgtatgttaaaagcccaacaatacttgttctaattgttactttaaataattttatgttagagaaactgagaaaaggaatgaagagcaagtatacatttatggagtttttatatttaccctcttattaccattttggttctcctcaccgattcctagggattcaagttgcaatttggtgtcatgatactccattacaactttggtaccacccgttttctttgtacagttattgcaaaatatgtttccatatgttataggttcaacaatataattagatggtttgtgtaagttttttaactgaagaaaaggagaagaaatatgcatttacacaatctcttacaattacagaattacctttacttaaggtgctctttgtttttcatgtggagtcaaattactgtctgaagtcacctgctttcaacctgaagaacttcctttggtatttctcataagtcggtatgctgcttaatttccagatgtttgtctgttactaatgagttctttcagtttttcttttctaagaatgtttttatttcaacttcatctttgaaacatagttttgtaaaatacaagattcttggttgactgttttctttcagcattctgaatatgtcaccctactgccttctgccttccattattcctgatgagcagtcagccactaatcttattggaatatccttgggcatgatgagccatttttctcttactactttcaagattttcttatctttcaggattttttttttttctttttggaggcagggtctcgctctgtcacccaggctgtgattgcagctcactacagcctcatcctcctgggttgaggtgattgtcccatctcagtctcctgagtagctgggattacaggtgtgcactactacccctggttaactttttttttttttttttttttttttcaaagagatggggttttgccacattccccaggctggtcttgaactcctgagctcaagcaatccacccttcttggcttcctaaagtgcagggattacaggtgtgcgccaacatgccaggcctcagcgtttttattaccatgtgtctgcatgtggatctgagtattccgacttggattctttgggcttcttgaatgtgtgcattaatgatttacattacatttgggagattttcagcattatttctttgataatttttctgttactttatctccttctggtactcccattatgcatatcttggtgtgcttaatagtgccccacattattttaaggccctgttttctttattctttcttccctctgttctttagaatgtttaatctctatcaacctattttgctgagtctttcttctgccagttcatatctactgctgagtctttctagtgattttttcatcttgattattatactacttaaaaaaaagttttttttgagacaaagtctcactttgtcacccaggcgcaactgcagtggcaccatctcagcacactgcaacctctgccccgggttcaatcgattctcatgcctcagcaatccaagtagctgggattccaggtgtgcaccaccatggccatctagcttttgtatttttaatagagatggggtttcgccatgttggcctggctgatgtcaaactcctggcctcaagtgctccgcccacctcagcctcccaaagtgctgggattacaggtgtgcaccaccatggccatctaacctttatatttttaatagagatggggttttgccatgttggcctggccaatcttgaactcctggcctcaaatgctctgcccgcctcagcctcccaaagtgctgggattacaggtgtgagccaccacacctggcctgattattatactactcttcaattctagaacttccactgggctcttttcaaatacttcctatctttttattgttattctctatttaacgacacattatcaaatagtcctttacttcttcaagcatagttttagttctttgatcttttttttttttttttttttttgagacagagtctcgcactgtcgcccaggctgaaatgcagtggcaggatctcggctcactgcaacctctgcctcccaggttctcgccattctcctgcctcaggcctccccagtagctgggactacaggcgcctgccaccacgcccagctaattttttgtatttttagtagagacggggtttcaccgtcttagccaggatagtctcgatctcctgacctcgtgatccgcccgcctcagcctcccaaagtgctgggattacaggtgtgagccaacgcgcccagccctttgatcatatttttaatggctgctgttaaatctggtatctggaccctttcacaggaaatttctgttgcctgctttttcttgtgtataggttacacttcctgttttttgtgtgtatgtctcaatttttgttaaaaactggacattttaggctgggtgtggtagctcacgcctgtaatcctagcactttgggaggccaaggtgggtggattgcctgagctcaggagttcaataccagcaactaggtaaaatcctttctctactaaaatacaaaaaattagccgggtgtggtggcatgcacctgtaaccccagctactcgggaggctgagagagaactgcttgaacatgggagacagaggttgcagtgagccgagattgtgccactgccctccaacctgggcgacaagagactccatctcaaaaaaggacattttaagtaatatactgtagcaactctggatactgattccccctccttcagggtttgttgttgttatttgcttatttattagtttagtgacttggttagactattttcgtaaagtctccttccccaaagactggtgaagattttcatgttgtgcctcagagagtgcaaccttgggcatgtacagagtctccctgggatgacattgagccaggctgtctttgactagctctttccatgatctctctgttaagctttctacctcttctggtatcacatccagctgttaggctctactaactgctgactgaattctcgactgtttttgataatgccctggagtatacactgctccaaagtctaattcaattaaattcaggaaggggtaatttttgaaattgagctttgttctgaccttgggagagttcttctcagctgtctccttccctggttctctggtgaactagctggcctgtagatcaccctgttcttaattaagaagagggtacctggccaggcacagtggctcatgcctataaacctggcactctgggaggccaaggagggtggatcacttgaggccaggagtttgagaccagcctgaccaacatggcaaaacccgtctctattcaaaaaagagaaaatataaaaaataaaagagtaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaagagtaaaaaaaaagaagaggtacctctttttatttgcttaccatcaaaatctcctcaggcatgaacttccctggactctgttcttattaactgcctctctctgtgggcaaattctcagagcagggtcagtagcctctagtcttccgggcttgcctctcccagtgtaaaacctctgtacatgagcaagctagggcaaaggtgatcagagccatagaattcttggcctcaagtatgtgggatagagcttccacaccgtgagtacagtatggagctgggtggaggaaggaagcctctgacctctttgccatactcaccgagaacttagtctcttcaatttggagctggagggaagaagaaaagctgatggccccccactcccaatgagaaacctattccttgtttgggagctgagaattcctgggtttgtatattctgaacctgctggccagagtcaaatgctttaaggctgggcacctaaccaaagatgggccagagttctttaccaggaagctggagctgagactgggagtcttcttatttaataggcagtcttctgcctagtcccatcaaggggaccaggaaaaggtagggtacagtgagagagaagactaagaaacactgtagaaagaaaaagagacgaggagagaagtttctaggttcctaagaatgctctggttactggttcttgttagtccctgagacacagctgtctcaggtctgcaacaaagcccttctccctgaaatcaggtccactttggggagttcaatgaagtttctgtaacaagctgtcaaaagagtcttaatagtcatggtctagaattgccttgaggacaattctactctgagcaaatctcaaattaatccttcttggaaagaagagcaagaatggtcccaggcgcccaaggaaaagctcccgatcactcaggggacccatccttccataccttgattgtgctctgactcctcattggccactcgcatcagggcatctagcaccaaagcattgtctagccatgtgtaccactcttccaactcctgaaggaagctggctgtgcccgttgactctgacacctttcgagtcgccagtttgcaaagccgctcaacaaagccaggaatgctgagaagggccgctgccagggaaagaacaagcgaggaaattttcaaaatagagaccagcaaaactacccctaaagccctaacaaacaatctgcatgataggaataattcttactctgatagtagctaaagctactcttttaaaatgaatgtcaaaccaaggtaaatagtaattatgttacaggcataagctcagtttttagcaggtacagggaaacaggctttttatctactgggaatataaattagaataatctttatgccttaaatgtgtgtgtctttgagccaagaggtcaatttctgggaatttaccataacgaaataaccagtcatattacacgagaatatctgtataaggaggttcactgatgtggtttctgtaacagcaaaaaggtgaaggtaactaaatgttcatcaacagctgattaattaaatacaatgacacatttatacaatggaatactgcatagacactaagaatgatgacacatacatctttatatagtgactcaaaacagctgtttacttgttagagagtaaattattaaacaatatgaatttaattttcttcaaaaatttaaatatttgcttcttcaaaatacacaaggaatgaaagcatatataccaaggaatttactgtggctgttcctaagcaggagagaatacaaacaattctcttaaaattactcatctatagtttctaattttcctgtaacatttactagcaggatgaaagataaacatttttttaaggtaaagaaaaaaactgaataatcacccaatttttctttccaccaatctcattttattcacaatgagtgaggtggaaattctgatcggcatattagaacatcataaactttggaggcagggagatccagattcaaatcctgactccatcatttaaccttctttaaaatgagactaatgcctgatcatgtttgcctgtatatgcattaagtctccctggaaggacagaaaagaagccaagagcagtggctgccacagtaaacagccataagatggaaacagccaaaatgtccgtcaagtggaaaaggggatttaggtcactgagagtaacagtggaactgaaacttttcaataaatacctttttgaatccgcagattttttggaaccatgtgaatgttacacctaattaaaaattaataaataactagatatttcaggatatcaagggattactattaatttttgatacagtggcagttacgtttcttaaaagtcgttatcatgtagaaacactgaaatatatgcaggtgaaattatacgatgtctggggtttacttcaaaataacccaaggtgaagtagggtatagtgaatgggagtagagataaagtaagacaagctggccaggcacggtggctcatgcctgtaatcctagcactttgggaggccaaggtgggtggatcacttgaagctaggagtttaagaccagcctggtcaacatggcgaactccatctctaccaataatacaaaaattagccaggcgtggtatcgtgcgcctgtagtcccagctactcaggaggctgaggcatgagaattgcttgaacctgggatgcagaggttgcagtgagctgagactgcaccactgtactccagcctgggcaagagtgatactctgtctcaacgcgtgcgcacacaaacacacacacacacacacacccctcccataattagtgagtggctataagatgatgtttgaccttagttataaaataaaactacattgaggttcctcaaaaagttggccaggcacggtggctcacgcctgtaatcccagcactttgggaggccgaggcgggtggatcacaaggtcaggagatcgagaccatcctggctaacacggtgaaaccccatctctactaagaagtacaaaaaattagctgggcgcggtggcaggcgcctgtagtcccagctacttgggaggctaaggcaggagaatggcgtgaacccaggaggcagagcttgcagtgagcggagatcgcgccactgcactccggcctgggcgaaagagcgagactctgtctcaaaaaaaaaaaaaaaaaaaaaaagtcaaacataaaattaccatatgacccagcaatttcactcctacatatatacccaaaagaattgaaaacaggtgcacacacaaatatgtgtacacacatgttcatagcagcactattcccaacagccaaaagatgaaaatatcccaaatgtccattaactgaagggataaacaaactgtggtatctacatgatgagtattattcagccatataaaggaatgaagtactgacatgctacaacattaatgaaccacaaaaacattatgccaagtgaaagaaaccagattcagaaggccacatgctatatgattccatttacagttatgcactgcattaacgctgttgcggtcaacaacgaccacacagaagacggtggtgccatcagattataatactgtatttttactataccttttttctatgtttagatacacaaatacttaccattatggtacaactgcctactgtatttagtacagaaacatgctgtacaggtttgcagcctaagtgtatcatgggctataccagctaggtttgtgcaagtacactctatgacattcacacaatgacaaaatcacctcactgcatttctcagaaggatagagactgctaagtgacaacatgactgtatatgaagtaatctgaataggtaaatccacagagaaaaaagcagaatggtggttgccagcagttggggagaaggggtaatgggaagaagctgcttaatgtgtacggcgtttccttttggggtgatgaaaacgtgcaactagatagaggtggtagctgcacaacactgtaaatgtactaaatgccgctgagttgttcactttaagacggctaattttatgttacgtgacttccatctccataaaataattacacagaaatagatttttgtttgagacaccatttttttttttaacatatcagcttggcaaatataaaaaagtttgataatgctctgtactgggaaaggctacagacaacacggtggggaagatgaacaagtaatttctttggagggttaatttgtcaacacttaccaatttccattaatgggggactaattaaattacagtatgcctgtataatagaatattatataattacaaaaaggaatcatataattctatatatactagagtgtaatttttggcaagataagtttaataaaaagagagcagcacttattttatattacctatttacattaccatctgtacaaacaggagtcaatctctctctgtccctccctccttcccccgtcccatgattgggcatgtatagaatatttttcgaaggacgtttaagaaactggtaaaaagttaccacagggaggggaacaaactctctgctgtactttttgtatcatttaaaaaaaattttaggtgtgtattattttttctaaaaacaaatcagtaggcggggcatggtggcccatgcctgtaatcccagcactttgggaggccgaggtgggtggatcacctgagtttgggagttcaagaccagcctggccaatatggcaaaaccgatgtctactaaaaatacaaaaaaattagtcgggcctggtggcgcatgcctgtagtcccagctacttcgcagactgaggcacgagaatcgcttgaaccagaaagtggtggttgcagtaagccaagattgtgccactacactccagcctgggcaacatagccagactgtgtctcaaaataaaacaaagcaaaaaaaacaaaaaagaaataaaaagaatttgtattctacatgaaaatcttcacatagctggatttttactcttatacttctgttctcagcaaaaatagctcctgctgcttgacctgctcctctcaggacagcatgtaggagctagtcttccccattcctgcacactcaacacactcctccagatgggaagtgcccggtactcagggttctaagtctgacttcccacctgagattcttgagctgttgtgagtcactcacctcttgaaaagctaataaaagctaagaccttctccccagaaaaaaattcactggaccaatcatacctagcaactcatacacaatctcatgggctgacatcccagcatatccagtccttgtaattctcacagctttatcagtagctaccacacctggctggttaatgttaaactgacaactaaatcactcacaacccctgagaatttctgcagaagcaggcctcttctctcttctcactgttgaaacatcagtattccccccatactcctgtagtttcccctcctgctttccagcttcatgtgctgcataattcagcccctctcagctaagtgtcacttataaattgacaattatctagcctatagcttcatttacatctctgctaagaatcttgaaagacgttactttcccccagaaggaaaccagctgttctcttctaaatcgacagaagaacaactggtagttctgagaatctcaaaaaggactcaaaaaataattatttattttaaaatgaatctcaaaaaataatgacttacgctatcttcctggggctcagataatttacattagataattacatgtaaattatctgagccccaggaagatagtgtaaatcattatttttgctagacaagaaaatgacctcacagccacagtttattaaaaacgaaacgaaaactttttggcaacatcctacatatttcagctttccatacagttatggactgtgtccccaccccccgcgcccccacaaattcatacgttgaagctctagccctaaatatgactgcgttttgaaacaggccctttagggaatgcggtggtgtgatggttaattttagctgtcaacttgactggactatgggatgcctacatggctggcacagcactgtttctgggtgtgtctgtgaaggtgattccagaagagattggtgtatgagtgtgtgaactaagggaaaatctgccctcaatgtgggcaggcaccatccaattggtgggggagcagtgggaggcgatggaggaaaacaaaaagggattctcccccttctggagtgggaagtttttctcctactgctcttggatatcagactccaggatctttggcttttggtctctgagacttgcaccagcagtttctggggtcctccagccggggagctacaccattagctttcctggttctaagttttccggacttggactgagccatgctaatggcttctcaggttctccagcttgcagacggcttatcttttattttatttatttatttttggagacggagtttcactcgttgcccaggctggagtgcaatggcacaatctcagctcactgcaacctctgcctcctgggttcaagcaattctcctgcttcagcctcccaggttgttgggattacaggcgtgtcaccatgcccagctaatttttgtcgcagatggcttatcatgggactcctccgcctgtgatcgtgtgagccaattcccctaacaaatcccacctcataaatcctactgcttctgtctctctggagactgctgcctaatacagggaagtaattaaggttaaatgaggttacaaagtgtggggccctaaaccgagaggactggtgtccttctaagaagaggaagagacaccagagatctccgtctctcctcaatgacagagaggaaaattcatatgtggatacaataaaaaggtggccttctacaagccaggaagaaaggcctcaaccaggaaccaatcctgacagcaccttgatcttggacttctagcctccagaactgtgagaaaaataaatgtctgttagttaagccacctagtctacggtaccttgttatggcagctcaagctgactgatacacacacctgagataaaggcattcactactggagcgcaattcaagaatgataacattcagaggactaagactttcctcatccactcgtgatttaattatgtccaccagcttggccttcccagggcatttgaatggagaaaatcgtgcgggtaagggaatggagtaggaattatggtcagggttgggaagggtcagatcctgcacaacctcatgtgtggaactacaacttttaggctttatcccaaaagctacaagcagaatcacacatagactgtctactaggctagtcacacagatatgaaagtgaatctagattattttatagagactttaagaaaaaactcccaaataaaaaaacaaaaacaaaaactgggctttccgttctcagttaatcaaaaaagcccagctgaccagaacagttcattcctcaagaataatgggtaatgctggttttacttaagtcagtttacaaataggcatctgaaagcaatcaatactaacaggatcaaaatcatctgccagaatagattccttaaatgggaaactaaaagatgaaagttacttagtgcctcggcatacacaggcatccaatacagaacctttctagccctcagtttcctcacatgtgcaatggggatactaatctctattccacagggcacttgaaggattaaataaaatcacttctaggtaaagcagttacccagcgtttgccacataccaggagcttagcaaatactaccttttgtcaatgtatatggaggtgtgtacaccagctctgaggtataatttagttataatgaaagtcactttttttaaaattatactttaagttctagggtacatgtgcacaacgtgcaggtttgttacatatgtatatatgtgccatgttggaaagtcacatattttttaaaaatgtaaatttcctaaaatgagaactcccccaaaatcataaaggagtgggaagaaaaccgtacacagaccaaggaagaccttgtatctagtgacacaggaggaaaagcaaatctagagagagaataaactggggttggagtccacaaacttctacctttacatatgactacaacatgtaaaattatattccctaataacctacaaagtatagttatgatcacctcatgttcctaactaaaactagacaataacagagtgaatggcaggttcatattcagcctcaggagaggaggctgctctgaagcacttgataactctgcagagccagcctggggaatgcacacaactggactttagaaacaaagaactgttttcagagcatgattagggctacctctgcatggtcatggttttctactgctgctttttaatgatacatttgtataattttaccttgtttatttggtgtaccataaggtacacagtgataggtttttgtattaacaatatttccagcctgttaacattgaaaaactagcttttaagacacaagtttcagttcaaatatgaattatctacactcttatgaccaaaatacatctatgccagtttctccaaaatctgtgcaggcaacaacattttagatagaacacagttcttttgctactgaacagaaataggtgggctagattggttagaatagtgttttgtttttaagtaatatatttacacggttctaaaatcaaacaatatatgaaagtatacagtaaggagtcccactcccactgctactaccttcccttaccagctacttcctattaataaccactttatgtttcttgtgtaccctttgtttctttaggcataccatatatgtgggcaaacgtatggtcttattctccccctgacttaatacaaaaactataccatatacacactgttctgtattttcctctttatcattaatatatcttggagatttttctatagcagtacatagagatcttcattttttcaaagctacacaattttccattatataaatattgaatacactaagcagtccagtgttaatgaacatctgggtttctagtcttttgttattacaaataatgttgcaatgaataatttttttttttttttttgagacggagtctaattatgtcgcccaggctgaagtgcagtggtgcaatctgggctcacagcaacctctgcctcctgggttcaagcaattatcctgcctcagccttctgagtaactgggactacaggcgtgcaccaccacacccagctaatttttgtatttttagtagagatggggtttcgccatgttggccaggctggtctcaaactctgaacctcaagtgatcctcctgcctcggcctcccaaagtgctgggattacaggcgttaagccaccgtgcctggcctcagtgaataatcttgtacagtagtcctcccttagtcaagaccctcacagtggatacctgaaatggcagatagcaccaaaccctatatatactatgttttttcttatatacacacataactatgataaagcttaatttataaattaggtacactaagagattaacaataactaatgataaaatagaacaattgtaacaagatgctgtaataagagttatacgaatgtggtctctctctggaatttttcagttaatattttcggattgcagttgaccacggataactgaaaccacagaaagtgaaactgcagacaagaggagattagtgtctatacatcattatctataaaatgaaggcccaggagagacttagtagatcaaaaagtatatgcatttgtaattctgataaaaagtagttcttaactttttttgtggttctgagcccattaacaaatctaatgaaaggtatggaactcagttcccaaaataatgaacagatacacaaaatttacatactaggagccttcacatggatccatctctagagatatttaaaaggggtgctaggtgtggtggctcacacctgtaattctagcacttcgggaagatgaggtgggtggatcacttgagaccaggaagtcaagaccagcctgggcaacatggcgaaaccccatctctacaaaaaatacaaaaattagcccggtgtggtggcacctgcctatagttccagctactcaggtggctgaggtgggaggatcacctgagcctggggaggtcaaggctgcagtgagccacgattgtgccactgcactcctgcctgggtgacatagtgacgatcccatctcaaaaaaggaaaaaaaaaaaaaaagaaaagaaaagaaaaagaaaaaaaactagatgatttagtaagggcctcagagctataatctcaaaattctgagaacttggagactttaccttgattgatttcagctgcagaaggccccaaactcaagctcttcttctgttgagcatttttggcaagaagcgtgtgcttgtcatcattccctgtatccatctctgaaatggtgacagccagaatccggcagaaattagcgagctgctgctgatcgaaattggatactaaggaactcagattggggacttcatctagtcggatcatttcctacagaagacaaaaatgaaacaatccccatgctcaattcactcaagagattggatgtgcctctctttcgcatccccttacatacggggcttagtggctagatcacttaggttcctatcccagctctgtaacttgcagctctgaaactttggttaagttacaaaaacctttcgagtctttgcttgtttatctgtaaaacggaactaatctacctcacaggattagtctgaggactaaatttaccttttgagcaccactgttttcaattgttcttgtggtatattttgcctatttaaaaaaaaaggaaatgcctaccactcaagttttggaaatcataaattaccattcttgctacagatttgcttttttaaaaaataaaatacttcaaatatagctaaaggcctctgtgtatcccccatccagtcgcatttttttctctccctgcagacgtaaacattattttgaactctgtgtttattattcccgtgcatgtttttatacttacaaatatttccattaaaatacatgttactgctctgcatgcacagtgtgaatgataccatactataccttacttttcatccaacattttgaagtttatctacactgatacaagcagctgattcaatcacttcccgccgttttaccccacagtttaatcatctctctcttttaagagacagggtctcactctgttgctcaagctgcggagcagtagtgtcatcatagcttactgcagactcaaactcctaggcccaagcaatcctcctacctcagcttcccaagtagctaggactacaggtgcgtgtcattacacctggctacttttttaatatttttttttttgagatggtatctcattgtcgcccaggctggagtgcagtggcgcaatcttgactcactgcaaactccacctcctgggttcaagtgattctcctgcctcagcctcccaagtagtggggattacaggcgcccgccaccacgcctggctaatttttgtattttttagtagagatggggtttcaccatgttggccaggctggtcttgaactcctgacctcagatgatccatccaccttggcctcccaaagtgctgggattacaagcgtgagctaccacgcctggccaatactttatttttatggagacagggtctcactattgttgcccaggctggaactcctggactcaagcaatcctcccaccttggcctcctaaactgctgggattacatgtatgagccactgtgcctgaccctttcttcttttaatacatatttaggtaaactacagtttttcactattaaacaatgttgcaatgaacattcttacaggtactctctgtgtacacatgtatgtgaccatttatccagagtgagagcaagaattcttgtctttttcttgactttaccagaaataattccaaaacattaaaattaagttcaatatttgctgtaaattttaatatcctataagttaaattttaataaataccctatatatagtttataagttttccttctattgctagcttttattaagaatgataattttatggaatgccttgtgctatttggttctattctcactcattactccttaaaatctgtaaatggcatgtactacatcaacttttctcattttgaaccatccccgtgctactcagataacacctgctatccttcatcccactaatttacttccactggattgggtgtttctctttcactgcacagatcacatgaacttttaataatctgttcctgcatctatttcccaaataatctgaccatactttgatgaaggcatatatcctaccctttctcctgagactcaatgcacaggacctggtagcaagggtatcagtgaatgtgcccaaaacgagtgcatgattcctagaagctctcatgaatcccatactcgcctctatttctagtaatggaggacaggaatttgctgtgcagggggcattggggaacaactgcttccacttttccttttccctagtacaaaacaaatgtaagctactactattattggcaactgtaacttgtagctcaccagttcctctagccctgtctaactcagtatatggttcccaaaacaggtcccaccacccccagcccacttcttatggttttttgttttgtcttaaattttaagatttttttttttaaggcggagtctcactgtgatgcccaggccagagcgcaatggcacaatctctgctcactgcaacctctgcctcctgggttcaagcaatttttctgtcccagcctcccaagtagctgggactacaggcatgcaccaccatgctgggctaatttttatatttttagtagagacagggtttcaccctgttggccaggctggtctcctgacctcaagtgatctgcccacctcggcctcacaaagtgctgggattacaggcatgagagccactgtggctggccaagaatttacttcttatgttttaatttttgatatgtacaatacgtattatgcagcacaacaaaatgactagctgtgtgtgcctttcctattgcatctctctgcctctgggaaccaccatcattaattattattgccttgccatttaaaaactagttttatcaacaaataatttgcttttttgagctttatgaaaatgatatactacctacagtgttctgcaactggcttctaccactcgattatttcaattactcagctatgttgttgcctatggcaacagttcattcatttctactatataatattccattgtgtgaagaaagtacattcatcccttctcctattcatggatcagagacttggtttcagttttttgttctgaaacaacgaagctacaaatgttcttatgtgtttcttgatgcacaggtggagaagtttttgctggggcagtggcttctaaactttttagctatcaccaagaacgaccaccagtaaacatacatattggaatgtatatagaaatgtcaaacaaaaacttattcaaaaaatacccttacacaatacagtttgatcttttctacttggctggtagacccgatggactgactttacaaccttctgggtttcaatcctaagaatcactgttctaggactgagcttccccacaagtgtgtccaggcacaggttataggtaacccatggcaaaatactgatgcctcagccctcagggtaaagcttccctaggtgctggggcacaagatatgtgcctgttcaactacaaaacaaaaaaaaagaggatattctgctgataaacatttatcagtagtatacaagtgtttccactgatacacacactcaccaacatttgcccactctctccctcactatggtattgatttgcatttccttgattgccaatcaagttaaacatcttctcttttatgtttatggaccatttctttcttgtctgtgaaatgcttgttcataacattgcccatttgtctactgggctatttctctttttcatgctgatttgtaagaattctgtttttttttttttttttgagagggagtcttgctctgttgcccaggctggagtgcagtgacataatcttggctcactgcaacctctgcctcccgggttcaagcaattctcatgccttagcctcccaagtagctgggactacaggtgtgcaccaccatgcctggctaatttttgtattttttagtacaaaatgagactgggttttgccatgatggccaggctgttctcaaactcctgacctcaagagatctgcctgcctcagcctcccaaagtgttggaattacaggcatgagccaccgtgcctggcctgtaagaattattgataaattctgaatacaacaaatcctttgttggttacctgaattcaaatgtcttttcccagtttatggtgtttccactttctttatggtatctatccccctttcaaactgcaccaagatacccataatgtttggtggaacacctcgccattttggggtacacaaaaaggaatgagagggagtgagaggcaagtgggaaaagttgtgaaggagcacttctagactcctatgctgagactgctaaggagtctggagtttccactctggaggtcccctttcacacactggctggaacacacaattactggaataacaacaaagcctttttatcaaagggcacaaagggtctgtctggggcctgcacacatctccaatgtgttcctacagacaataggccacttgtgctgggcaatgacaagcaaggcctggggaaagcacagcaagaagaaatgaacgctgggttcaccacagtgcacatgaacatccacctccctgcaacagcaacctctaggaggctgctcaacaggaagagaaagaaatctgccaaccagcaaccaacatggaggctcaggacagattaggactggggaggtgagctccaggtcctaacaagcattacaccaaaaatgtaacacagtaagtctctaacagagatctatgaatgtatttttgggtatctgtgaattcttgaaatttttaatttagttttcatttcgatcatagctgtttttttttttttttaaagttatgggtcatccgaatattaaccttatgaccaagtggcaggatttcagagctcccatttgtctcctactgcgctggtgccaattaaccaactttaattgttgaagactaatgagaaaaaatagaggcggacttcataagtgaaagccaaacattactaccaaggagaacatatcctaatgaatgaaggcttcacaccagttcagatagcggtaaagtggtaagagaatggagtcactgcatagcatacaatagcacatacatgctacaaagaacttgccccaacggtgatgagtgaggggcaatttgatttcagcaaagtaacatgaggcatcaccctacattcacagagtcaatctgaagttctgagttttagaattagtttgatttcaatgtatgtctgtttaggttttacagtcatttaagaaccactagtataaggggtaatcaagttttatacttgaatacatctgagtaacaagacataatttaacactttcttttaaaaaagctctgtatattattcagttttgagaatccaatggtctgagacacccttccccatctggtcagctagaggacacagctcacctttttaacacccaaaatatcttcaatgagggttgctgtttgtaagaatgtcttcttacttgtcatcaatgtaaacaggaagatcacaaagtcattcttttctgccaaacgctttgtaactccctctgtctgtcacaagaagaaaaggcagaataggttgtaagtacaaaataaattatgaaagtacaaggcatcctttacagacactgaaaagcagtttcacctctgaaaactggcatgagtcaacaaaacaggaatggcatggcttaactgtgggaaacgctcgttaactccccagctatggaagaaaaaagtctcctgacgtgcaggctacacaagtgggaactcacttgtgagaacataacacaatgagatggtatttcctaaaataacttatctcagagttctgaaggccattcttaaatctgaaatcaaacagtgccgaagcatggacttaagagtcagacctaagttctaattccagctgtgtgatcctgagcaaatcacttctcacctttggaactccatttttttcatcagtaaaatgatcatcttaaaagtctttgaggccaggcgtggtggctcacacctgtaaccccagcactttgggaggccaaggtgggcagatcacttgaggccaggagttcgagaccagcctggccaacgtgccaaaaccctgtctactgaaaatataaatattagctgggtgtggtggtgcatgcctgtagtcctagctactcaggaggctgaggtaaaaggatcatttgagcccagaaggtggaggctgcagtgagcctagactgtgcaaatgcactctagccttggcaacagagggagaccctaactcaaaaaaaaaaacaaaacaaaaaaaccaacaacaacaaaaaaacaaaacccccaaggggtatgaaggaagttaaggaaactagctggtaaaagaccttaaaacttaggttcaagagtttggatttaaaactgcagtattgtcaagtgcagtggctcacacctgtaatcccagctaccccggaggctgaggtgagaggaccgcttgaggccaggagtgtgaggccgcagtgagctacaatctgtctcaccactgcattccagcatggggacagagtgaaaccctatctctaaaaagaaagaaactgcagtactgctatagcttacacacacacacacacacacacacacacacacacacatatatatcccacccctactgccttaaggcaactagagcttagtgactttaatatttcttttttttagcctctaagctgaaaaaattccaaggtttactgcgataaacttgacttctccttaaaaagtataatcaagagtgcagacacacacagtttggtaaatgggaaccccaagctaggaggcatttcagaatcagtgaaatgagatatgttgcaacaaatttaattttctttcttttaattttagagacagggtctcactctgttgcccaggctgaggccatgactattcacaagtacgaatatagctcactacagcctcaatcacctgggctcaagcgatccccccacctcagcctcctgaatcactgggactacaggcgtgcaccaccgcacctggcaaatttaattttcaaagtgaaggcatcaataaagatgtgccacgtatataaatctttgacgatcacattaaataggacactaaagaaagcaatctccatctgtattaatacatttcggttcttcagtcgtagcactgacacattaaaaaaaaaaaaaaaaaaggttgttattcccgaactacatacagtacctacactggctatgatatgtgaaacaggactgactctagttttactgacaagcaaaagttctggaagatccaaagaaacagaacaaaaagagaactaaatttacactttctcaaagcttaaaaatctatctccaggctgtcaaatacacaaccctgctgctctaactagctacccttgactacccacctttctcctctcttcaatttatcaaagtgctactccttttacagactgactaaaatgactcctcttggaaaaccttcccaagtcaacagtggccacccaaaaggccatcacaatccttcctttcctctatatcacaagttcttaactgaggccaaaaagcactaaaacaatatataaaaggttgtatgcaactacatttttcgggggagagttttttccatgtaacattcatcataggtttttttttggtttttttttttttttggagacagggtctcactctatagcccaggctgagtgagtacactggcacaatcatggctcaccgcagccttaacctctcaggctcaagcaatcctcccacctcagcctcctgaggagctgggactatggtatataacaccacgtccagccagttttttattttttgtagagacaggttctatgttgcccaggctggtcttgaactcctggacacacacaattctcctgcctcggcctatcaaagtgttgagattataggtgtgagccactgcgcccagcctaatcataagctcttgacctagtatctgtcaagtatctaaatgaggagctacaaactagcatccagtaggccaagctttttctggtgagcagtactgtttatttttttatcttttattttttgagagaccctcactctgtcacccacgctggagtgcagtggtgcaatctcagctcactgcaacctctgcctgctgggttcaagtgattctcttgcctctcctgagtagctgggactataggcatgtaccaccacacctggctaatttttgtgtttttagtacagacggggtttcaccatgttggccaggctggtctggaactcctgacctcaagtgatccacccgcctcagcctcccaaattgctgggattacaggtgatagccaccgtgcccggccaacagtactttttaaacttttgaattcaaacatctttagacaggacatacttgctccagtttagtcacagtttacacaagtccccactccaacaccagcaattccaaacatttcctgttttctgcctgatccctggaggcattggtgtttgcaaccctgagagccccaggttctctacattaacatggaattcagccagatagcacataattgaaccatatcgccctatgttcctcaaattttttaaaaaattttatttaaaaatacttttagttgatatataataaaggtacataatttcagggagcatataatttaatacattcgtataatttataaaaatcaaatcaatgtacttgggatagccatcagcttaaatacttgtcttttctttatgctaagaaccattcaaattctcttctagctattttgaaatgtaaaacagaacagaatattataaactaagtcacccttactgatttatctaacactaggtcttatttatcatcccatatatttgtacccattaatcaacttctcttcatacatttcatttttttaacttaactgttttattggaatgtcactgattaacattaggtatcatgattttaaaacggcctcataaaactagtgactatatggagttgccaaagatggagtcattatattatacactgtcttcttctataaggacaatttcttattggccttagttgcaagaactgtgcatttcctgaacaatttgaaattttatcttatagatctccctgtgcctatctctgtcattggctatacatggctaccgagcacttaaaaggtggccaggccaaactaagatgtgctctgggtgttcaaacaagaggaaagaaaaacaaaacacacacacacattggattttgagagctcaatacgaaaaacaagtaaatatctcattaataattaattatactgattacatgttagaatgacaatattcttgatacactgtgttaaacagaatttatcattaaaattaacttcaccacttcttcctacttttttctttaaaaaaatgtggctacaaggaaatttaaaataacccaagtggcttgcattatatttcaattgcacagcactattatagatgctgaattacgtaagtgttcaaacatattcccctatttgtgttggctgctaagaagcttgaagccaaatttgtgcccatccgtaatacagatgattttatggtcttcatttttatatcagcccaattcctggctatacgttatgtccccacctttatcttcttctttcttacctgcttctaagttcgtgatcttggtagattttgcatacacccacaagatgtcagaaatcttattttgaatgaggcaagaaatgaaatggagctaaatgtttttttttttttatttccacagcatacagggttcacatttataatagcgctcgtctcattctgccatgtattatgattcacagtttacacagtttatcataagtttctaaaagacaggtactgtatcttttaaaaactaacatttatatattgttttacaaagtgttttcacatctactatctcatttctcacaataaatctatgatgttaatacaactgctaactgcattctattggtaagaaactacggcttgggaggtgtactaagccaagggccagaacacaaaatcaggtcctaacactaagtgccatcctcttttgtttctaccagattgctttctttattcaccattcttcctggctcagtggtcaacctagtagagtcctgctcaatatatgggcggggcttctggttctcattttgttttctaacaaggaaaatgaagaaataggcataatggagttaaaatgagtcttaaaggtcacagtctgccaacacttgtcaccttttgacaagtgtccagtttctacttggacagctctaaggccaaaggagtttactacctgctgcagcagtcctggctcttaacaactgctacaaaattctgcctccccgtaatttctaccagttagtcctgattttcaggcacacataaaataagcccgattcccccactgtctgaaagcagctcttatgtctgccattctactcgaatattcccatcttaaacattgcagacctggtaggggagataaacagagccccagtggcaggggtacttacacagacacaggtattatacaggatactcaagcagtccttggacatttcatcacttactgaaagtgaaagggtaatgactggttatttttctcaatgaaaagatagtacaacagttaccacatttttttcagcataagaactgttataatcccctccaagatgattatttttcctttaatatacttcttccagcccctgtctaccaaaggttttcatagtgcccatcagaacctacaagcccatttgcatattgcttttggtttgatacagcagctgttttcttattatgctccacagtcttcataatttcaacctgttgttgtgccatcatttaataaagccattttcccttaatgtcttgcttaggatatatctaggatttgttttttttgttttttgtgttttttggctatttaagtagaccacaaatgaacaacttaatatatatgtgtatccttttcatgtttgtattaaactagttcctcaagatacattttcaaaagtagaactactagaatctaaagtataggcatcttttttttgttcatttgttttggttttttaaatgaggtcttactctgtcactcaggggcacaatcacagctcactgtagtctcgaactcctaggctcaagcaattttccctcctcaccctcccgagtggctaggactgcatgcgcgtgtaccacgcctggctaaaagttaaaagtataagcatctcaattgctcttgttataaatttccattgaaagttctactgcagcaaacaaaaataccatttttatcagactcattaactgagcatttctttttttgttgctgttatctgtgttgggcaaatggctcttaatgtctgatctattactaattcttataaagaaactactacttccctgtgagcaggaacaggaaagtagcataaaaacgaaacttaattttcatgagcccaaaaccaaaagatgatgaaactgagtatgaaccatggacaaagtgctttatttggcacttgcttctattttttaaaattgtttccattcactcctaagctgctaggaatgctaaaatgctaggtctccttctcagatcccaatgggcagccctgccaagctagcttgactagatgggttgtctcataatcctgagacaacgcagacgctctgcatcccttatcaccacctttcaacctactggggctctgtgattgatttatttaacgacttcagagcagggtgaaacactgctctgcatgtctcactatatatctcactatttctagatcctccatttttaaaaggaattgggattcactcattcatcaagtattgttcagcatctactctagagcagatacagtggtgagggaaaaaaagtctcagccttcatggaacctataaatctagtgggaagaagagagactaaacaagtgcaccaacaaataattacaatatgctacttgctatgagggtacatagagaacatgaaagaccaagttagaatacacagctgagacattaaaaatgaatataaatcctcttaataaccactactgcatgcacaaatgaggccttatacagtatgtcgtattggggtaaaaaaaaaatcttttaaattaaaaaaacgcaaagttggtaggagggcattcaccaaacattaactgaagtcatctctggcttttaacaccagagtaaagtgcattcacttttttattttaaattaaataccgaagctgggtgcggtggctcatgcctgtaatcccagcacttgggaggctgaggtgggcagatcacttgaggtcaggagttcgagaccagcctggtcaacatggtgaaaccccatctctactaaaaaaaaaaatacaaaaattagccgggtatggtggtgggcgcctgtaatcccagctacttgagagggtgaggcaggaaaatcacttgagctcaggaggcggaggttgcagtgagccaagatcatgccactgcactccagcctgggcaacagagcgagagactgtctcaaaaaaaaaaaaattgaatacctaaaaagaattatttgtaacgtgtaagttataaaaaataataatagaatattacccatatatctaccacccagcttaagaaatagtgcataccaaaacactctgactttttaccattcacaccctggtaatgcctgaactttttacaaagagcatgtatcacctttctaaaaaaaatagtttaaaaaaaataaaacagagtgatcttactctctcagctagttatatgtgagaaagaagaatttcccaaggaaacatagaagctggatcacaggactatcaaaagtacaaagatgcattctcttaacccagatctgaatttctacgcagtacagaatgaataaagacagctgcttagctgggggaggagagagcaacctgtagctaaatgtaagacatgtccttactattaagagttaggaagggaaggaagaaggcagctgctgggaactgccaccgtatcggcaggttggaaaacaaggaccagtagctaataggtatacttacttttcagtttctgtccccggatagagatcgtaggcctcataagaatttctacaagaagctataaaaaaaattagataaaatcttcaaaattaattcaaagtataacttataaaatgattttgccataaccattcatggcccatgtatctgtcacagtattacaagacccttttgttccaggaggcagttaaggttcagtaaggctcctgactgcagcaagtcaggagacccaggttctagtcccagcttggccacctacttgcccttctctggcctcagctttctcatttttgaaaagaagtattttagattaggtaatctctgggatctaatgcggctttaatttctgaaaagctgcagaacattattactatgattcttctgtttaaagaacatttgtaagtttattttaaaaggactcaaaagatacaccataaattgttaacactgatttctacaggtttgggggttatatgcatgtgttttttattttacatactttaatacaattttgcacaaactgtttaaaataagcatgtatttaaaaattcattctacggagagaaaggatagttgataaaagggtcaatccattagaaagatataacaactacaaatatgtatgtacctaacaatagagcccaaaaatacatgaaacaaaagctggcagaaatgaaggaaacagataatttaaaaataaaagttggacacgttaataactctgctttcaataatagacaactaggcagacgagcaaagaaatagaagacttgaacacaacgaacacatatattctaacagacatctacagaacactccatgcagcaagaacagagtatacattctactcaagtgcacatgaaacattctccaggacagatcaaatttcaggccactgaacaagcctcaataaatttaaaagcacttaaatcacatacagtatgttgtgtggccacaatggaatgaaattaaaatcagaacgaaatttgggaaattcatgaattatatggataattttaaaaacccatcctaaataataatgggccaaagaagaaaccacaaggggaagtataaagtatccaagaaggatgaaaataccaaaacttatgatgtagctaatggagtgctcagagggaaatttatagctgtaaatgcctatattaaaagaaaattcttttttttttttttttttttgagacagagtcttgctttgtctcccaggctggagtgcaatagccctatctcggctcactgcaacctccgcctcctgggttcaagcgattctcctgcctcagcctcagagtagcagggattacaggtgcctgccaccactcctggctactttgtgtatttttagtagaaacgaggttttgccatgttggccaggctggtcttgaactcctgacctcaggtgatctgcccaccttgacctcccaaagtgctgggattacaggcatgagccaccgcacccggccaaagaaaattgtttctaatcgataacctaatcttctaccttaagacactggaaaaagagcagactaaacccaaagcaagcaaaagggagaataagagttgaaacaaatgaaacagagaatagaaaataacagaaaatgaacaaaaccaaaagctggctctttgaagactggcaaattcttaactagactgaccaagaaaaaaggagagaggatacagattactatactcagaaataaaggagagggcattaccaccaaccttatggcaacaaaagtgattataaggaactactatgaacaactgtatgccaacaaattagatgacctagacgaaatggacacattcctagaaagacataaaactaaaaactgacttaagaagaaacagaggctgagcatggttgttcatgcctgtaatcccaagactctgggcggctgaggtgggaggactgattgaagccagaagattgagaccaccctggccaacacagcaagaccccatgtctctacaaataaaataaattagctgggcgtggtggtacgcctatagttccagctacttgggagactgaggcaggaggattacttgagcccagaaggttgaggctgcagtgagctatgatcatgccaatacactccagcctggatggcagggtgagactccatctctttaaaagaaaaaaaagaagaagaagaaggaagaagaagaaagaagaagaaataagaagaagaagaagaggaagaagactacgacgaagaagaagaagacgaagaagacgacgaagacaaagaagatgaagaagaaggcgaagacgaagacaaagatgaagacgaagaagatgaagacaaagaagacgaagatgaagatgaagaaaagatgaagaaaagacgaagacaaagatgaagatgaagaagacgaagacgaagaagacaaagacgaagaagacgaagaagaagaaaaaacagaacatctgaacagccctataacaagtagagactgacttagtgatttaaaaaaaaacaaacaaaaacaacaataacaaaaaactacccataaagaaaaaccttggacatgatggctccattggtgaacaatacaagacatttaaagaatgatcaattcttcacaaactcttccaaaaaacagaagagaaggaaacatttcccaactcattctttgaggcgagtattaccctgataccaaaaccaaacaaagacatcacaagaaaactacagatgagtatctcatgcatatatacacaaaaatcctgaaaaccctagcaaacaaaatccagacacatacaaaaaggattatactccacgcatgatggcttatgcctgtaatcccagcactttgagacgtcaaggcaggaggactacttaagcccaagagtatgcaaccagcctgggcaacatagtgagaccctgtctctacaaaaattaaaaccaaaaattagccaagcatggtagcatgctcctgtagtcccagctactcaggaggccgagataggaggctcgcttgagcccaggagaggctgcagtgagctgtgatcacaccactgcattccagcctgggtgacagagagaccttgtctccaaaaaaaaaaaaaaaaaaaaaaaaacaagaaaaggattatacaccatgacactatgacaaagtggaatttatcccaggaatgtaaggttggttcaacatatgaaaatcaatataatacaccatatcaatagaataaaggacaaaagccaaaagccacacggtcatctcaacagatgcagaaaaagcgtttggaaaaaaaaacccaaaacactttcatgataaaacaatcaacaaggaatagaagagaacttcttcagcctgataaagggcttttattaaaaaacccacagctagcatcacgcttaacagtgaagactaaatgctttcccattaagatgaggaaaaagacaaagatgtccactctcgccacttcaatttaacattgtactgagtgttctaaggcaactagagaaaaataaaaaaagaaattaaaggcacccaaattggaaaggaataagtaaaactaactatttacagatgtcacaatctagaatacagaaaattcctaaagaatccactcaaaaaaactattagagccaataagcaagagttcagcaagatttcacgatatgtgatcaatatacataaatcaactgtatttctaaaattgtagcaagaagcaaaaaaaactggaattatgaaaacaattccatttaaaggagcatcaaaaacagtaaaaacacttagaaataagtttaacaagtgcaagacttgtacaacaaaacatttttgaaagaaattaaagacaatctaaaaaaatggaaagctatcttgtagttcatggatcagaagatttaatattgttaagatgataatactccctaaattgacctacaaattcaatgcaatcactatcaaaatctcagctggcttctttgcagaaattggcaagctgatcctgaaattcacatgcaaatataagggatgcataacagccaaaacaatcttgatctgtaaatacaaaaataaacccgtgtctatgatcagttgatttttgacaaggttgccaagacaattcaatgatgaaagagtagttttttcaataagtggtgctgtgacaactggatagtcacatgcaaaagaatgaaactggacccctgcctcacatgataaacaaagtcaatgcaaatggatcaaagatctaaatgtaagatacaaaatataaaattctcagaagaatacataggtaaatctttgtgaccttggattaggaaatggtttcttagatgcacaccaatacccaagtaacaaaagataaaatgaacttcatcaaaattaaagactttgtgtttcaaaggacaccatcaagagagtgaaaagacagctacttaatgggggaaaatatttgcaaattacaaggaattagtatccagaaactaatacaactcaataataaaaagacaacccaatcaagaaatggagaaagcagatgaacagacatttctccaaaagtccaataataaacagatgatcaacattagtcatcagggaaatgcaaatcaaaaccacaatgagatacctcttcatacctactacgatggttataatgaaaaagacaaatagtaactattggcaaagatgtggagaaattagaaccttcatacactgctggtagatatgtaaaatggtgcagctgcttcagaaagcagtctggcagatccttaaaaattaaacagagttaccagcaactccacttctaggtatataccaagggaaattttttagtaagacaatctaatagaaaatgaaaacacgtccacctaaaaatttatatgccaatgttcatggcagcattattaatcatagcagattactaataatagccaaaagtgggaacaacccaaatgtccatcaactgatgaatggataaataagatgtggtctatccatacagtggaatatttcttgacaataaaaaggaatggagtattgatacacgttatgacacggattaaccttgagaacattatgttaagcaaaagaagccagtcacaaaagaccacgtattgttatgactccatttatgtgaaatgtccagaataattaaatctataaagacagaaagtagattagtggttgcctaaggatgtgggagggaggccttgggaggaaatggggagtggctactgaagaatatggtgtttcttttttggagtgatgaaaatgttttaaaatcaattgtggtgacagtggtatataactctgactatactaaaaaactgaattatatcttttaatatatcttttaaatgggtgacttgtatgacatgaattatatctcaataaagctattatttaaaacaataaaacacctcatgctcagttatagaagctagacataaaaagccacacagtggacgattctgttgatatgaaatatccgtaacaggtgatatggtttggctgtgtgccctcacccaaatctcaccttcaattgtaataatcctcatgtgtcaagggtgggaccaggtggaggtgactggatcatggaggcaggtcccccatgctgttctcgtgataacgagggagtctcatgagatctgatgattttataagtgtctggcatttcccctgcttgcactcactctgtcctgctgccctgtgaagaaggtgcctgcttctcctttgccttctgccatgattgtgagtttcctgaggcctcccaggccacatggaactgtgagtcaattaaacctccttcctttataaactacccagtctcaggtatttcttcattgcagcatgagaacggactgacagaacaggcatattatggacattatggatatttcacaacaggcataatacagacataaaatagattaacggctgccagagctggggagaaggggagatggggagtgactgctaatttgtacaagatttctttttggcgtgataaaaatgttctggttatcactgcacaatactgatgggtggttacaagaattaactttatgtaaattatatttcaataaagctgttattgctggggaggcagggtggctcgtgcctataatcccagctactgaagaaggtgaggcaggaagatcatttgagaccaggagttggagactgcctaaggaacaaagcaagacccccatatctctaacaaatattaaaaaattagccacgtgtgatggcatgaacctgtagtcccagctactcgggagactgaggcaggaggatcactagagcccaggggttcaaggctgcagtgagctaggatcgtaccactgcactccagcctgtgacacagtgcaactctatctctaaaatcatcccaacaatttttaaaagctgtaattaaaaaaaattctgttaaacaaattctaggttaatataaacagaaaaaaataaatgttagaaaggaatactcccgaatcttaacagtggttgaattttggtgacaagtcccaagacagtttttcacattttccttgacaaacaccttttccttttaaaatgagaaaaattaggacctttgttttccaaaaaagtccaattttcacttaaagcatttaaaaattatctatatgctgagaatatgactaagcccatatgtttaaagacattccctatatacgtatgtattttttattattgtttaaatcaagctaggagctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattgtcaattctagagaagcactgggctcagctttctgcacatctgtatttattgttaactgcacttgcaggagggaaaagaaagaagtctcatgacttgaggcaacaatgaaaactgccctgaacatatgcctgctttgctttgtataatagagacctaaggtcatcctctagaaaaggtgaagtaattattatacagtatataaccattttatagcctgttttcatcatgaattttcccatattactataactttaacattatattaacaacttcataaaattcaacaaaatagatagaataaccattatcttctcctggtagatagtcattacaaataatgttacacctaacggtcttggtatacacaagctttatctcattttgacttacgtcttcatcagagtcacagaaatggaaacaacagggcaaaatgagtagtaatgtttaaagctctgaagtatactacaccaattcttctcaaaagagatcacattcatccaagtaagacgtaagatgctcaagtgcatagaatgtatttaaaataaattaacttcaaatggaagatagactatgtcagtgaataaaagttcctgaatgccaagcaatggcttacacctggcccacaattactgaaaagctggaagatttttacctacaaatctagatttcccataacctctcagggaaacactcaatgggagaggaagagtcatttcctccataaaagcaggcacacactctctagcccaaaacattccccatactcatttaatttatgcagatgagcttgctctgggtctgcttcactccacttagttacatacttcacatctgctttgtaaactctaagacacacttttcacagtcatgttatggatagggtcaggctgacaaggagtgatcccactgagctttgggcagcatgaccaagagaggcttactttgggttcttgctagttattagcagaggaagaaataacaagctgtttggaaaatactaccagcagcaggacagcaagagagttcactaacaaatgcacccaaactgaaggtcagtgaggtgcataattacttaagcaggagcccatgtttataaaatgactgggattcctggagaagctgccctaactcaaagcaggaaagaaaaacccccacaaaatcaagaacagttgatccaaagatgtccgaagatgggataggctcctactagagagccacatttccactgcaaatagacacaggctacagacctacattattatttttcctcccataaatacatcagttcttactaagtagatttcttgatgaaacaattcaaaagtaaagggtctcttgagctagccaagtaagtaaatgccctaggaccaccgacactgctgtggagagggaatgcggagcagcagttaaagaagaaaggctgtggctgatgccatgcatgcagatgtcacactcaatctttactttactggaaaatggtagctttaaacaaaaggaaactttaataattgaagtataacgtgataccgcataaagagtacaatttttttttttgagatggggtcttgctctgtcacccaggctgcagttcatggtgcgatctcggctcactgtagcctcaacctcccggactcaaccaatcctcccacccagcccccatcaagcaactgggactgcaggccatgtgctaccacaatcggctaatttttttaatttttagtagtgatggggttttgccgtgttgcccaggctggtctctaactcctcaactcatgcaatccgcctgcttcggcctcctaaagtgctgggattacaggcatgagtcactgtacctggccatgagtataaattgcacatgtagttttacacactgaacaccattcctgtacaatcgccacatagatcaagataaagactaaccataatacccagaaatgccctctccctcatgttcacttcaggtaatggggttaagggcagatatctaggggagcaaagtcagatcctaacccctcagtcattacaccaaaataaacttcaaatgatgcaaaaatttaaacatacacaataaaaactgtaaaatattagaaggaaataggcatggtttaaatccaacagtgggaaaggcatgaaccaaaactctgaagccattatagtaaaacactgatcaatctgacaatctaaaaattaaacatttctaattttaaaataacatcaaaatttaattctcaaaatagtaaaaaaacacaaatgacaaaggcctttaaaaaatcaaaagcacttacagatcaataagaaaaaggacaaataatcaaatcgaaaaaggtgcaaaacagaaaactggcagaaaaggaactacttataaacacaagaaaaaatatccaatctcagtcatagaagaatgaattttaaaaactatgcagagaatttataaagaactcttacaacacaatattcaaaagagatatatctcaactaagaaattgaaaaaggagagacagacatttctccaaggaagatatacaaatgacaaactcaagaataagatggtcatcattggcaatcagagaaattcaaatcaagaccacaatgagatgtctcttcacactcactagaatggctgtaatcattacagggctggagcgggggctcatgcttgtaatcccagcactttgggaggccaaggctgggggactgtttgagtccgggagtttgagaccagtctgggcaacaaagcaaaacgccatctcagtactttttttttaaattttaaaacactttcaaaatgacagataacaagtgttggcaaggatacagaaaaactgaaacccttatacactgctggtggcaatgtaaaatggcagggcctcttggaaaacattctggcagttcctcaaacaattaaacatagagttaccccatatgacccagcaactgtattcctaggtatgtatatgcctgagagaaatgaaaacatgtccacaaagaacctgtgcaagaatgtttatagcactgttattcataatagcaaaaagacggaggcaatccaaatgcctctcaacaaataaaaaatgtggcatatccacactgtgaaacatcatttgaccataaaaatgagtgttgatacatgctacaacacagatgaatctagaaatcattacgctaagtgaaaagaagccagtcacaaaagaccacatattatataactaaatttatacaaaacgtccacgacagagaaatctatagagacaaaaagtatactagtgtggggagagggggaggaggtggtagaggtaggggagtgctagataaaacacatggagtttcttttttgaggtgatgaaaatgctctaaagttgactgtggtgatggttgcacatatctgcaaatatactaagaaccactgaattgtgtacttcaaatgggtgaaatgtatggtatatgaaccatatcttaataaagctgattaaaaaaaactatggaaaaatatcacttttctcataactgcttagtaaatacttaaaatacactgtttgtggaagggggcttctgggtactggtaatgttctatttcctaatttgggtggtagtgcaaaagtgaatgtattttgtggtaattattggtgtacttttctgtatgaaggttatacttcagtaacaaagtctataaaaatacacacataaacacagtatgttggtgatggtatgggtaaacagacgctcatactttgttcctggggatataaactgacaaaacttcttaggtaggtaaacttcagatttataaacaataaaaaacatacgttcttgttccaaaggtatatactcacatgtatacaaaaatatgtaaaagatctttactgcaaccttgtctgtaagagaaatggtgtggaaaaattataaatgccagtcaactggggcctgggtaaataaattatggcacaatcacaccaggaaacactaaccatttaatttttttttgagagctcatcacccaggctagagtgcagtggtatgatcttggctcacggcaacctctgcctcccggcttcaagcaattctcctgcctcagcctcctgagtagctgggattacaagtgcctgccaccgtgcccatctaattttggtatttttagtagagacagggtttcaccatcttggacaggttggtctcgaactcctgacctcacgatccacctgccttggcctcccaaagtgctgggattacaggcgtgagccactgcgcccggcctaaaattgttttaattaaaaaaaaaaaaagaagaagaaagaaggtacagaatagtgtagccgtgtatatggtatatcactctatgtgcggagaaaataaactaaggtggaggtggtggggaatatttacacacacacacacacacacacacacacacacaaaaaaaacaaaacatcttaagcaggacacacaagaaactagtaatcacaactggttctgaggaggggacactgggaaatttagagatgtacttttcacttagtatttttttaaaaaggtatacaccaatttaaataaatgaattcttctgaagtaaaaactatgctgcttcaacatgtaaatgccgctaagcttctaaaagttaaaatctgaaatgttataaattctgaaatctttcctatctcccatttcaaaagttaaattcccaaaccattaagcagtagtaacagcagtagtaataataaatagctacttacatcaacacctccaaacaagtcaaaaatgtaagtatttggataagtggtttcttgggtaagtttcctctcttcagtaacaaatgccatagcctccatggagagaagaggagaaatttcctagtttttttaaaaaaaagtacatacattgttttagtaaccaacacagaccagacactaaagcatcagtttgagctttagtcccaactggagttcccatgaacacaaagacagtccccaatgaaccacacttcctagtattcaggcccctgtaaagccccttctcacactaaatctgggctggtatgacacacctcaactaacagcatgtggtagaagtgacactaggccacttccagcacaagccttaagaaagccaggctcacacctgtaatcccagcactttgggaggctaaggtgggcggattacttgaggccaggagtttgagaccagcctggccaacatggcaaaaccccatctctactaaaagtacaaaaattagccggatgtggtgctacacacctgtaatcccagctactcaggaatttgaagtacaagaagcacttgagccacggaggcagacgttgcagtgagccaacatagagccactgcactccagcctcggcaacagagggagactctgtcattaaaaaaaaataaaaagcctgacagacttcgctcttgccatcctggaacccaaacatcatgctgtgagaacacagccaatggggaggccataaggagaagaaatgaggccaagagcaacatccttagttgatctccagctgacagccagcaccaacctgccagggatgtgagagagaccattttggacattccagatatctcagtaccaccctacccaacagcacatgaagcagaggagccactcagtcaaccaagaattgttgacagataaatgattcttgttacttccggctgctaggtttcggggtgactagttctgtagcaataaccaagtcactgctcaaatataatctcctgcaggaagtcttcttgatttcccccaaccagaagcatgctcttcagacccccaaaacaatctacaactcatttgtaacatttagcacttttactttgcacctatttacaaaccatttctttttttttttttgagagggagtctcgctctgccacccaggctggagtgcagtggcgcgatctcggctcactgcaagctctgcctcccgggttcacgccattctcctgcctcagcctcccgagtagctgggactacaggcgcccgccactgcgcccggctaattttttgtattttcagtagagacggggtttcaccgtggtctccatctcctaaccttgtgatccacccgcctcggcctcccagagtgctgggattacaggcgtgagtcactgcgcccggccaaacctatgttatttcttccctagactaaacgttccttgaggacaacacaaacagatcccactttgtattccccacagattccaagacagagtatttgatacagcacacatagggtagtagttctcaaactgacggccacagaatcctttgttcatatggaacaaagctaagaggaaaaaaaatcttacaagaaaacctaaaacatagtaagtttcaaataagtacttacttaatgaataaagaaatgatgatcacatagcaaagatatacaaatattaatttccctcccctttaacttcacctcaatctcctgagattttgcaagaagcaaataatgtgcaactctttgaaaagcatttttaaacaagtttaagaagctataattatttctatcagactgtgagattcaaaatatgaaaatgtctcttcttaaacgtaaagactaagtttaattagtttctattacattttaaaataacttactatgtgatataataatcaaaacttcacctctgaagaacactgtcattcagtttcattacgttcaatataacttacatggtttttatttatttatttttgctgttttttattttattatactttaagttctagggtacttgtgcacaacatgcaggtttgttacatatgtatacatgtgccatgttggtgcgctgtacccattaactcgtcatttatattaggtatatctcctaatgctatccctcccccctccccccaccccatgccaggccctggtgtgtgacgttccccaccctgtgtccaagtgttctcattgctcaattcccacctatgagtgagaacacacggtgtttggttttctgtccttaacgatagtttgctcagaatgatggtttccagattcatccatgtccctacaaaggacatgaactcatcattttttatggctgcatagtactccatggtgtatatgtgccacattttcttaatccagcctaccattaaatggacatttgggttggttccaagtcttttgctattgtgaatagtgctgcaataaatatacacgtgcatgtgtctttatagcagcatgatttataatcctttgggtaaatacccagtaatgggatggctgggtcaaatggtatttctagttctagatccttgaggaatcgccacactgtcttccacaatggttgaactagtttacagtcccaccaacagtttaaaagtgttcctatttctccacatcctctccagcacctgttgtttcctgactttttaataatcgccattctaactagtgtgagatggtatctcattgtggttttgatttgcatttctctgatggccagtgatgatgagcattttttcctgtgtctgttggctgcataaacgtcttcttttgaaaagtgtctgttcatatccttcgcccagtttttgatggggctgtttgcttttttcttgtaaatttaagttctttgtagattctggatattagccctttgtcagatgggtagattgcaaaaattttctcccattccgtaggttgcctgttcactctgatggtagtttcttttgctatgcagaagctctttagtttaattagatcccatttgccaattctggcttttgttgccattgcttttggtgttttagtcatgaagtccttgcccgtgcctatggcctgaatagtattgcctagattttcttctagggtttttatggttttaggtctaacatttaagtctttaatcaatcttgaattaatttttgtataaagtgtaaggaaaggatccagtttcagctttctacatgtggctagccagttttcccagcactatttattaaatagggaatcctttccccatttcttgcttttgtcaggtttgtcaaagatcggacagttgtagatatgcggcattatttctgagggctctgttctgttccactggtctatatctctgttttggtaatagtaccatgctgttttggttacagtagccttgtagtatagtttgaagtcaggtagcgtgatgcctccagctttggttcttttggcttaggattgtcttggcaatgtgggctcttttttggttccatatgaactttaaagtagttttttccaattctgtgaagaaagtaattggtagcttgatggggatggcattgaatctatcaattacctcgggcaatatggccattttcacaatattgattcttcctattcatgagcatgggatgttcttccatttgtttgtgtcctcttttatttcattgagcagtggtttgtagttcttcttgaagaggtccttcacatcccttgtgagttggattcctaagtattttagtctctttgtagcaattgtgaatgggagttcactcatgatttggctgtctgttattggtgtataggaatgcttgcgacttttgcacattgattttgtatcctgagactttgctgaagctgctcatcagtttaagaggattttgggctgagacaatggggttttctaaatatacaatcatgtcatctgcaaacagggacaatttgacttcctcttttcctaattgaataccctttatttctttctcctgcctgacttccctggccaaaacttccgacactatgttgaataggagtgtgctgagagagggcacccctgtcttgtgccagttttcaaagggaatgcttccagtttttgcccattcagtatgatattggctgtgggtctgtcataaatagctcctattattttaagatacgtcccatcaatacctagtttattgagagttttcagcatgaagggctgttgaattttgtcgaaggccttttctgcacctattatcatgtggtttttgtctttggttctgtttatatgatggattacgtttattgatttgcatatgttgaaccagccttgtatcccagggatgaagccaacttgatcgtggtgaataagctttttgatgtgctgctggatttggtttgccagtattttattgaggatttttgcattgatgttcatcagggatattggtctaaaattctcttttgttatgtctctgccaggctttggtatcaggatgatgctggcctcataaaatgagttagggaggattccctctttttctattgattggaatagcttcagaaggaatggtaccagctcctctttgtacctctggtagaattcggctgtgaatccgtctggtcctggactttttttggttggtaggctattaattattgcctcaacttcagagcctgttattggtctattcagggattcattcaacttcttcccagtttagtcttgggagggtgtatgtgtccaggaatttatccatttcttctagattttctagtttatttccgtagaggtgtttatagtattctctgatggtagtttgtatttctgtgggattggtggtaatatcccctttatcattttttattgcatctatttgattcttctctcttttcttattagtcttgctagcggtctttcaattttgttgatcttttcgaaaaacgagcttctggattcattgattttttgaagggttttttgtgtctctatatccttcagtactgctctgatcttagttatttctcgccttctgctagcttttgaatgtgtttgctcttgcttttctagttcttttaattgtgatgttagggtgtcaattttagatctttccggctttctcttgtgtgcatttagtgctataaatttccctctacacactgctttaaatgtgtcccagagatcctggtatgtcatgtctttgttctcaatggtttcaaagaacacctttatttctgccttcatttcgttatgtacccagcagtcattcaggagcaggttgttcagtttccacgtagttgagtggttttgagtgagtttcttaatcctgagttctagtttgattgcactgttgtctgagagacagtttgttataatttctgttcttttacatttactaaggagtgctttacttccaactatgtggtcaattttggaataagtgcgacgtggcgctgagaagaatgtatattctgttgatttggggtggagagttctgtagatgtctattaggtccgcttggtgcagagctgagttcaattcctggatatccctgttaactttctgtctcgttgatctgtctaatgttgacagtggggtgttaaagtctcccattattattgtgtgggagtctaagtttctttgtaggacttgctttatgaacctgggtgctcctgtattgggtacatacatatttaggatagttaactcttcttgttgaattgatccctttaccattatgtaatggccttgtctcttttgatctttgttggtttaaagtctgttttatcagagactaggattgcaacccctgcttttttttttgttttccacttgcttggtagatcttcctccatccctttattttgagcctatgtgtgtctctgcatgtgagatgggtctcctgaatacagcacgctgatgggtctagactctttatccaatttgccagtctgtcttttaactggagcatttagcccatttacatttaaggttaattttgttatgtgtgaatttgatcctgtcattatgatgttagctggttattttgctcattagttgatgcagtttcttcctagcatcgaaggtctttacaatttggcatgtttttgcagtagttggtatcggttgttcctttccatgtttagcgcttccttcaggagctcttgtaaggcaggcctggtggtgacaaaatctctcagcatttgcttgtctgtaaaggattttacttctccttcacttatgaagcttagtttggctggatatgaaactctgggttgaaaattcttttctttaagaatgttgaatattggcccccactctcttctggcttgtagagtttctgccaagagaaccgctgttagtctgatgggcttccctttgtgggtaacccgacctttctctctggctgcccttaatattttttccttaatttcaactttggtgaatctgacaattatgtgtcttggagttcctctcctcgaggagtatctttgtggcgttctctgtatttcctgaatttgaatgttgacctgccttgctagattggggaagttctcctggataatatcctgaagagtgttttccaacttggttccattctccccgtcactttcaggtacaccaatcagacgtagatttggtcttttcacacagtcccatatttcttggaggctttgtttgtttctttttattcttttttctctaaacttctcttctcgcttcatttcattcatttgatcttcaatcactgataccctttcttccacttgatcgaattggctactgaagcttgtgcatgcgtcacgtagttttcgagccatggtgttcagctccatcaggtcatttaaggtcttttctatgctgtttattctagttagccattcgtctaatcttttgtcaaggtttttagcttctttatgatgggttcaaacatcctcctttagctcggagaagtttgttattactgatcatctgaagccttctctcaactcatcaaagtcattctccatccagctttgttccgttgctggtgaggagctgtgttcctttggaggagaagaggcgctctgatttttagaattttcagcttttctgctctggtttctccctatctttgtggttttatctacctttggtctttgatgatggtgacatacagatggggttttggtgtggatgtcctttctgtttgttagttttccttctaacagtcaggaccctcagctgcaggtctgtcagagtttgctggaggtccactccagaccctgtttgtctgggtatcaccagcagaggctgcagaacagcaaatattgcagaacggcaaatgctgctgcctgatcctttctctggaagcttcatctcagaggggcacccggctgtatgaggtgtcagtcggcccctactgggaggtgtctcccagttaggctactcaggggtcagggacccacttgaggaggcagtctgtctgttctcagatctcaaactctgtgctgggagaaccactactctcttcaaagctgtcagacagggacatttaaacctgcagaagtttctgctgccttttgttcagctatgccctgctcccagaggtggagtctacagaggcaggcaggtctccttgagctgcggtgggctccactcagttcgagcttcccggccgctttgtttacctacgcaagtctcagcagttgtggacacccctccccctgctttgctgccaccttgcagtttgatctcagactgctgtgctagcagtgagcaaggctccgtgggcatgggaccctccaagccaggcgcaggatataatctcctgctgtgccatttgctaaggccgttggaaaagtgcagttattagggtgggagtgtcccgattttctgggtaccatctgtcatggcttcccttggctaggaaagggaattcccccaccccttgcgactcccaggtgaggcaatgccccgccctgcttcagctcacactccgtggactgcacccactgtctgacaagccccagtgagatgaacccggtacctcagttggaaatgcaaaaatcacctgtcttaggcatcgctcatgctgggtaccatagactggagctgttcctatttggccatcctggaaccggacccccacttacatgggttttaactgcattagagctggtgctctaaattcaaatttagatccaaactacagctaaagtttagatactccagccctactgaatcagaatttcaggggtggggcccagaactctgtgttttaacacgctcttcaggtgattcataaacacactccagtttgagaacaattatcctagcataatgtctccgtgctctttccactcatttcccaatcatcaaacctggccccttcaatcttcttacgttagtaataatattcaacaaccataaggcctcttccacgagccttcagcagtatgtaatcttctaaacccttttcaaaaagaatgtcatcccaatcacaggatagtgttgacctcccaaaattaagcaagcactgccacaaaataaacacacatagagcccaaaaggataacacagggaacctaatggtgattatcttgggatgatgggattataggtgatgtatattttcttctttgtactttttctgaatttctcaaattttctatagctcacacagtaaaaacaggctatttttaaaagccaacggaagggaaaaaaaaaacagcagacatcttgtgtcacctagaggccctgaatacgcccctccaaggtccttaagagttaccttgaggatgttttgacactcaacaaagtcactgtggaggtggctggtggtgtgcagcttgaggagcagctgaggaattccactccacttggattgtttgtccctctccgtcaaaaaagtctcagtgaactgtgagtcaaaaaaagagagaacatattattgtattattgatgataatagctgatacggcaaaggagagcagccgacttccaaacccacccaggacagttacaaatttatctctaagcactactataaaaagcctctttctataaatcttcaaaacctccccaacagcctattactatgttataataagaaggagggattggaaatactcttgtaccactcacaaacagcacaatatcattgagagtggacttagactcgtcgtaaatatatactggaaattctagggcaactgctaaaagtatttttacaagaagaataattgatatgctaagagatgaaaaataatggaaccatataaactgctcagttaagcccataaaaggcagaaaaagaggggaagacaaagaacaagtataataaaacaaacatggtatacattaatccaactatatcaataatcactgtaaatatctatgaatggtctaaacttaccaatcaaaggaaagagactaaaagaatggatttaaaaaaccaagatccaacaatatgctgtctacaagaaactcatttaaatatacatatagataggttaaaagtaagggaaaaggccaggcacggtggctcacacctgtaatcccaacactttgggaagccgaggcaggtggatcacctgaagtcaggagtttgagaccagcctggctaacgtgataaaaccccatctctactaaaaatacaaaaattagctgagtgtggtggcaagtgcctgtaatcccagctactcgggaggctgaggcaggagaaccgcttgaactcgggaggcagaggttgcagtgagccaagatcgcgccatggcaccccagcctgggcgacagaccaaaactctgtctcaaaaaatagaaaaggggatggagaaagataaatcacataaaaagaaagatggagtagttatattaatttcagagaaagcaggcttcataaaaaaattatcagaaataaagtgggtcatttcataatgacaaaggggttaattctccaagaagacataacaatccttatcatatatgcacctaacaacagcatgtcaaaatatgaggcaaaaactgcctaaaagaactgccagacaaaaaaatggcaaatcaactcttacagttaaaatattttaaactaaatgaaaatataacttatcaaaatttgtgggatgcagcgaaagcagtaataagccagaagtgtatatcactgaatgcatataatagaaaagaagaaatatctatagtcaataatctaagcttctaccttagtaaactacagaaagagcagtttaagcctacagcaaacagaagaaaaaaataaaaatgagagcaaacatcactgaaattgaaaacaaaaaatcaagagagaaaacaaaaccaaaagttagttctttaaaaagatcaatacgattgataaactctaaccaggcttatcaagaaaaaaagacagaaacacaaattactaatatgtggtacataagaggagttattattactgactccatggacttcgaaggatgataaaggagtattatgaaccgtttgccccaatatttgcctagcactttgggaggctaaggcgggaggattgcttcagctcaggagttcaagaccagcctgagcaacatagcgagagctcgcctctactaaaaataaaaaaaaaaaataagccaagggtggtggtgcacacctctggtctcagctactcagaaggatgaggtgagaagatcacttgagcttgggagaatgaggcggcagtgagctatgacagcaccactgcactccagcctgggtgacagagcaagataaaaaaaaaaaaaaaaaaagacatcattataaccaaagagtgaaacaactcaaatgtccatcaactgatgaataaataaaatatagtatatccatccaatggaatattattcagcaaaaaaagtaatgatgtactgatactacaacaaggataaatcttgagaccattatgctaaatcaaagaagccagtgtctaactgggcacagtgtctcatgcctctgatgccaaagtaatcccagcactttgggaggccaaggtggacagatcacttgagctcacaagtacaagaccagcctgagcaacatggcgaaaccccacctctacaaaaaaaaaaaaaattagccggatgtagtggcacatgcctgtagtcccagctactcgggaggctgaggtgggagaatggcttgagcccaggaggcagaggttgcagtgagccaagactgcgccactgcacttcagcctgggcgataaagccagaccttgtctcaaaacagaaacaaaaacaaagcgagactccatctaaaaaaaaaaaaaaaaaaaaaacctaaaagaagccagtctcaaaaggccatatattgtctgattctattaatttaaaatgtccagaataagcatatccagagacagaaagatcactggttggcaaaggctgtggggatggggaaactggggagtaactgctactgaataccaggtttcttttttgggtgataaaatattctaaaattgatcgtgatgatagatgcataactttgtgcatacagtaaaaaccactgacttgtacacttcagttttttttttttttacccttttatctccttagtttaccaacttgtacactttaaaagggtgacttgtgcaatatgtgaattacatctcaataaagctgctataaaaactaaataaataaatgaacataagtgaactttttaggatgacaatgttctaaaaccagattgtggtgatggttgcataacttcatcaatttgctgaaaatcactgaactgtacacttacaatgggtaaattttattgtatataaatcatgcctcaataaagttgtttaagaaatatttaaaagaagaaagaagagaaaagggaacaaaggataggacattaaaaaagcatatattgtattaagcaagtataaacaccaaaatgtcagttattacattaaatctaaatatgctaaaatgctccaattaaaaacaaagtttgggccggttacagggcctcatgcatgttactgcagcactttgggaggcagagacagacagatcacttgagcccaggagttaaagaccagcctaggcaacacagtgaaaccctgtctctaccaaaggaaaaaaaaaaaaattaggcatggcagcatgtgcctgtaatcccagttactcaggtagctgaggcaggaggatcccttgatgctaggaggccgagactgcagtgacctgtgatctggtaccatactccagcccgggcaacagaatgcaaccctgtctcaaaaaataaatagaaaataaaataaaataaaaataaaataaaataaaataaaaacaaagtttgttatgccacctaccagagaaacagaaaggctaaaagtaaaagaatgggaaataatactcaatgtaaacatataccaaaaggtagtataactatattaaaatcagcaagagcaaagaaaaagcattaccaagccaggcatggtggctcacacctctaatcccagcactctgggagaccgagacaggtagatcacttaggtcaggagttcaagaccagactggccaacatgatgaaaccctgtctccactaaaaatgcaaaattagctgggcatggtggcacaggcctgtaatcccagttactcgagaggctgaggcaggagaattgcttgaacccaggaggtggaggttgcagtgagccaagaatgcaccattgcactccagcctgggtgacagagtgagactctgtctcaaaaacaaaacaaaacaaaaacaacaacaacaacaaagtactaccagagataggcactttaataaggataaaaatggcaaactggataatgttaatgatcctaaatttgaaaatatctaataaaaacttcaacatacataaagcaaaaactgacaaggctaaaaggagaaataaggaaatccataatcataatgggagattttacacatctctttcaaaaactgatatatgcagacaaaaattagtgagaatacagaatattttaacacaattaaacaaaatggacacacctcgagcagtatatctagtaaatgcactctacatgtcctttacaaatacaaatagaacatttgcaaaatgaccagctgctaggccatactgcaaatgtcaatacatttaaatgaactgaaatacagactatgttccacatcagaaagatagttataaaatccccatgtttggaaaataatatacttctcaaaaatgcatgggtcaaagaagaaatcgaagtggatatatgaaaatatcctgaaagataatgaaaatactacacatccaaactgatgaggtacaactaaagccatgcttactgaccattataaccctgataccaaaacctgtcaaaaggaaaactgcaggccagtttcactaacgacgatgtaagggaaaaaccacaattcaaaaattgaattaaatttaaaatttgtatcagaaattaaaagttggtttaatatttgaaaattttattcaatgcaattcaccacattgataacataaaggagaataattatttgataacataaaggagaataatgatatgaatacctcaattgatacagaaaaagcatttgataaaatttaacatccattcatgataaactcaaataaaaaaatgaatttctagtaacaggtatccacagaaaacccactgcaaacatcatacttaatggcaaaatgtttaaggttttttccctcttagatcaggaacatgctacttctattcatcatactggaggtctcaggcagcagagtaaggcaagatatatagaagacataagattggtaagggtaagataaaagattcatttgcagatgatataatattcacagatgactgtacagtatacaatccaaaagaacctaaatgtaaattatcaactattacagcaatatacatgaataatataaaaatctatcttatttttatattacagctacaatttttaaatgcagttttaaaaacactacttacaataccacttttaaaaacgctaaggaataaatctaacaaagttatgcaagacggctacatagaaaactgtaacacactcttggctgggcacagtggttcacacttgtaatcccagcactttgggaggctaaggtgggcagatcacctgagatcaagagtttgagtctagcctgaccaacatggtgaaaccccatctctactaaaaataccaaaaaaaaaaaaattagctgggcgtgatggtgggcgcctgtaatcccagctactaggggaggctgaggcaggagaatcgcttgaacctgggaggcggaggttgcagaaagctgagatggtgccactgcactacaatctgggagacagagcgagactccatctcaaaaaaaaaaaaaattacaggaaaataacttccaatttatacttctatacccagtcaaactaaatatatgtgtcagaataagacattttctgatctgcaagctttaaaaaaaaaaaaaaagttacctcccatgtactctttcttgggaggctaccagagagtgtgccccaggaaaaaggaagacaattgaggaaacaaggtctaaaacatgagaaaagaaagaaaaatgctctggatttggtgaagagaagtcccaagaactcagctgtatagcagacctagtaagcagctaaactaaactgctaaactgctaaactgcagtaggggaatgaagggcttcaaatgatttctttaaaaaaaaaaaaaagttttagaatttaggaacaaattataagtatacagaaagcaggccgggcgcggtggctcacacctgtaatcccagcactttgggaggccgaggtgggtggattacctgaggtcaggagttcgagaccagcctggccaacatagtgaaaccccatctctactaaaaatacaaaaaaattagccagacttggtggcgggcacctgtaatcccagctactcggggggcataggttgcagggagccgagattgcgccattccactccagccgggcaacagtgcgagactccgtcccaaaaaaaaaaaaggtatacacaaggcaaaacaatttaaaaggatgcattatacctgacttcaccaccatgcgatacaccaatgtagcaaaatttcacttgtaccccattaatacaaatttaaaaacagtaaaataaattaaaggatgcactattatgctaatgaaagtcaaaagggtatatgtatatatgtgtgtatatatgtatatatgtgtatatatgtatatatctatatatgtatatacgtatatatgtgtatatatgtatatatgtatatgtatatatgtttatatgcatatatgtgtatatgtatatatgtttatatgcatatatgtgtatatgtatatatgtttatatgcatatatgtgtatatgtatgtatgtttatatgcatatatgtgtatatgtatatatgtttatatgcatatatgtgtatatgtatatatgtttatatgcatatatgtgtatatgtatatatgtttatatgcatatatatgtatatgtatatatatacagggtatatgtatatttatccttcaatttaaaaaatggaagaggactgtttttaacactacaaaaaaattatataaaacaaatataattgtacaatatatggccctgctgtaaataataatgctaacatcataatgtaaatacttaacaacagccaaagctgtgatataactacattggtagactagtggagacgagtaagaaggaatcgaatgtgtgaattaaatcctagtctttcaagagcgaagaaaatagatagtatctaaaagtgaaaagaaacagctttataaccatgttatttagaaatactggctctcctgtttcctggatccttctcttgcaaaagaaatagctaagtatggacactgaacagcattaggagtatggaacttagaggtgcaaagcaggcagggcactgctgtttttttgttacaagctccatgatacgcagagatctaatcacagtccaaatatttgacttcacaagcaatttctttactatttatacattgtcttacaaggcatgtactctcatttaaaaataataatttggggctgggcacagcggcttacactcatatcctagcacttgggaggccaaggtaggcccattgcttgatcccaggagtttaagaccagcctgggcaacatggcagaaccttatctctacaaaaaaatacaaaaatgagctgcgtatggtggcatgcgcctatagtcccagatactcgggaggctgaggtgggaggattgcttgagcccaggaggcggaggtttcagtagttttttttcaccactacactccagcctgggcaacagagcaagaccctgtctaaaaaaaaaaaaaaaaatcattagaattttgttttccttgtgaacagctcagcactgtgacaaaagtgccaccattcagtcatcttcccagttgaattactggcaggtatcacatgggttttctcttgaagtacttgtggtttaacagtttacagcagtgataatctcttacatcataccctctaaactgtcaacctgtttagcaaatatgacatttctagacatttacagtttccactgattttattgtttttaaaaataactaaaggctaaattccatgaagataactgtgcatcttatttgtttctttaatcctaaatgtaagacatctaatgcctcaaaataccacactaaatgcaagggtctcgcgcaatctcactgcaacctccgtctcctgggctcaagtgatcctcccacctcagccctgcccccttccccctcccagccccccacaccaccaccactgccaccaagtagctgggattacaggcacgcaccaccacgcccggataattttttgtatttttagtaaagatggagtttcacccatcttgcccaggttggtcttgaactcctgagcttaaagaatccgtctagctcggcctcccaaagtgctagaattacaggtgtgagccaccgcacccagcctaaatagatatcttaaaggataataaagataaaataccttgttgggttattctgacaatacatgttaaccactgaatacttttgtgtcctttaatggggtatgattcagtaaaattaggagcaaatttaagggcttgtgaatacgaaaacttcccattgaaatgaatggcatatgtgtgtgtgtgtgtgtgtgtgtgtgtgtgtgtgtgtgtgtgtgtatgtgtgtgtatatatatatgtgtatatatatgtgtgtgtgtgtatatatgtgtgtgtgtgtgtgtgtgtgtgtgtgtgtgtgtgtgtgtgtgtgtgtgtatatatatatgaataagactttatcctaatcaggagtttttcagtatcaaattacctttgaaaagccaggtaagatttgtttgacttaaatgcctaggtttcataaatactaatggttagaatgaggctaaaacaagtagtgcctaatgaaattttttttaaaagttagtgaatctggctgggcacggcgactcacatctgtaatcccagcactttgggaggctgaggtgggtggatcaagagatcaagagtttgagaccagcctagccagcatggtgaaaccctgtctttactaaaaatacaaaaagtagccgggcatggtggcacatgcctatagtcccagctactcaggaggctgaggcaggggaatcgcttgaacccgggaagcggaggttgcagtgagccgagactgtgcactgcactccagcctgggcaacagcacgagactccatctcacaaaaaaaagaagtcagccaggcgcagtggctcacacctgtaatcccagcaccttgggaggccgaggtgggcggatcatgaggtcaggagatcgagaccatcctggctaacacggtgaaaccccgtctctactaaaaatacaaaaaaaaaaaaaaaattagccaggcgtggtggcgggcacctgtagtcccagctactcgggaggctgaggcaggagaatggcatgaacctgggaggcggagcttgcagtgagctgagattgcaccattgccctccagcctgggcaacagagcgagactccatctcaaaaaaaaaaaaaaagtcagtgaatctaaagaaaaaatataaagtaaggaacactcaggggcatttagatatgccaataatcataaaggaagcaacgactgccatgtgggaaatataacagcatcccacaacccagtctgtcaccagattgccaaactgaagggcatccagggatggcgggtcatgacctgtaatgtgagctgcactatcctagagcccagcgtttactcagtctatcctttccttcaactcgtactgatcatttggggccttgtacgcccatggtaaggaatccagaattgattctatcaactgcaatgagatgaggctggagagttttaagcaaaggatttataagatctgatttgcattaagcatcaaatgtgctgatgaatatgaaaaggctcagtaaactccaaagtatcaccccagcatattttattgccttgacagagggcagaacaaaacgaagggaagaaaataaagcaaactaaaatccaagtagaattgacccattacaaattatgtggccagtagtcatgactcaggcttcccttatgccccatttagggagatggagaagatcaggtctgatggaaaagggagaggattttggctttcgacatactaagtttgagatgcccattagacatcaaagtggaaatgctagaaggcaattggatatacctacccatccagagctaaaaggagaaacacgaatggaaacagaaacttaggatccgtcagcgtatagagcagttattaataacaatacaagctaatctttatagcagtaagctatgtacttatagctgagaaagtatgtttcagtcactattttaagtgctttatatgtacaactcacttggtcctcaccacaaccttggaaggtcaggtcctatgatacttactttacaaataaataaactgaggcataaacagattaaataacttgcctaaagacacatagtaagtaaataccagagctaggtttcaaacctaggtaatctgactctggaactctttaaagccatgagattgcttggcaagtacagacagaaattagactgaggacacagtatttcaatttaagcaatttcctgaatatcaaatggctggcaaggtttcaggctctgcagatacaatgaaaaataagacacagtctcttcaggaagcccagtctaattaactactagctgagagcaactatttactaaacaactattcctatatgccacactggctacgcttttaaaacatattatttcacttaatcctcctaacaactttatgggatagatgttatcatcacctctttagaaataaggaaactgaagttaagagaggttaaataacttaatcttggtcaccctgctaggattcaattcaggtccaccttactttaaaatctgatttttttttccaaggaaattccatcacatgctataccacagatgatccttgaggacattatgttaagtaaaataagccagtcacaaaaagacaaatactgtattactatactggggttatctaaagtagtcaaactcacaaaaacagaaaggagaagaatggttaccaaggactgggagggagaaatgggaagttgttcaatggtagtttcagatttgcaagatgaaaaagttctggaaatctgtttcacaacaatgggaatatacttcacattacttaactatacaccttttttttttaagatacagggtttcaccatgttgcccaggctggtctcaaactcctgggctcaaacaatccgctcacctcagcttcccaaagtgttgggattacaggtgtaagccaccacactgggcctgacctatacacttataaatggttaagatggtaaattttatgtttacatatatatatttatatatgtatatagtttgaggcagggtctcattctgttgcccaggctgcagtgtaatggtgtgatcatggctcactgcagccttgacttgccaggctcaagcgatcttcccacctcgggttcctgagcagctgggactacaggcatgcatttccacacctggttaatgttttttttttttttttttgtagtagagctggggctccaccacactgcccaggcttgactcaaactggctcaggtgatcatcccatcttggtctcccaaagtgctgggattacacacatgagccaatgtacctggcctatattatatatttgtttactacaatgaaaaaattttggctaggcgcagtggctcacacctgtaatcccagcactttgggaggacaaggcagggggatcatgacgtcaggagttggagaccagcctgaccgacatggtgaaaccccatctctactaaaaatacaaaaagtagccaggtgtggtggcacacgactgtaatcccagctactcaggaggctgaggcagaattgcttgaatccgggagacggaggatgcagtgaaccgagattgcgccactgcactccagtctgggcaacagagcgagactccgtctaaaaaataaaaaataaaaaatgtttaaatctggtcttttcctactataccacatgccataacagtataaaaatatgggtaatctgggcaacagagcaaaaccctgtctctaccaaagatacaaaaattaatggggtgtggtggcacacgcctgtagtcccagctactagggaggctaaggtgggaggatcacttgagcccaggaagttgagcttgccactgcactccagcctgggtgacagagcaagattctgtctcaaaaaaaaaaaagggtaagcaaataacttattctgcaggatgggagagaggagcggaagggcacagcatggaataaattaaaaaaaaaaaaaactaagaaaagaaatatttgaaagatgaaggtccccattttatcctcactatagctccaggcagggggtctctacttcaacttctgaaatagctcccacacctatatacaaccatcagttaccacaataacctgccttgcttttgtggctccagaatattccagcagccttgtatctggtgagctttttttttttttttttgagatgaagtctcactatgtcacccaggctggagtgcagtggcgtgatctcagctcacaacctccacctcccaggttcaagcaattctcctgcctcagcctccagagtagctgggattacaggtgcttaccaccacgcccggctaatttttgtatttttagtagagacggggcttcgccatgttggccaggctggtctcaaactcctgacctcagatgatccacccgcctcgacctcccaaagcactgggattacaggaatgagccactgtgcccagcctctggtgggcttttctaggctcctcccattctaagtcattcagcactggaaacaaattaagttgcctaaattgcctcatttatcatgctaaagaacttctgtggctccctattattctcagaacactgattatcaggatgggtgtttaggaacatatcatctaacctctctgagcctcagtttcctcatccatattaagaaatgagtcttgaagcataactcaaaagcttgaggattaaagataacatatgccttgtaccgtactttttctaaaggttatgtgctcactaaaagttagtcctctttctgcctgtctctacacacccagctcggtaaggtatcttagcttaagaaggaaagagcaagtatttctaggatttttttttttttttgagacagggtctcactctgtcaatctccgcctcccaggctcaggtaatcctcccacctcagcctccccacaggcacacaccaccaccatgcccggctaaatttttggagacacaggattttgccgtgttgcctgggctggtctcgaattcctggattcaagcgatctgcctgcctcggcctcccaaagtgctgggattacagggtcttaagtcaggtcttaagaacacaagggggaaaaaggctgctcatctatggttgtgtgatggccaggaaaacatttctcactcacaactgctcctttcgtccacagtcctccatacacacagaccccctagcctttattttattctatccttttcgtcatttgaggaagtgatattcaaattaaatttaaataaagttacactgtgaaaagtctcactcccattttctccccctttagcccaattcccacctcactcccaccaaccactttatcagtttcttgagtatccttcaaactttttatgaaaaagctgtctttaaataaagctaatgttttacaggtgttagcaaggttcggggtgggggagggtggaagaagtagtggactaggtcctattcaacctggtttaccctaaagcagtgtccttcgctcactcaaaaataacaataatcatatgttgggcacctgttataagtcagatgcttaatattaactaccttcagcccttagtatgcaccagaaatgcactaatgctttacacaattgccccctttgatctccacaacaatcttaaaaggtaggttactaattctcatcttcatcttacaagtgaggaaactgaggcacagaaaggtcacctgcccaagcaagagagaggagcagggctttgaacccaggcctgactccagagtccctcttaaccgtgacgctctacactagcaaaccagatatagtctctgcacccgctggaactcagcctaatgtgggagacgggcgagaaaaaggcagacaacaaagaaatacgaaattatagactaagaaagtaatgtaaacgaaacgaattcgcggctgtgacagaataacaatggggacctactttagaaaggggaaggaaagagtgtcaaggaaaggcctgagaaaatgacatttatgaaatgctcgggaaccatttgggggctgcaatgatgaccccctcccccacgcccaatacacgggataaactcgaggcccacagaggctaaaacaaacacgacagggtcccccagacgtgtagacgtggcgcaaagaagggaggatccagaaactgggcccagggttcgtacacgccatcagtgtccacagcagcccagccccgctcggcccctgacaagggacatcaagccagctgcttcccacggccccgctgcagctgagagcgtccgggcagctcacagggaggccttccggccagccaaaagggctttggcccgtccagcggcggcctggaaaggcctcttccccggccccccgccagctcccgcctggtccgccccgccccgcccctcctggtccagcctcgtacctgcaccgcccggaccaggccccggccggtcagctggccctgccgcagctgcagcagaatgttaccaggccgcggccggccgccccatccgccccaagccgccactgtggctgccgaccgtctccctcggccggctccagacccagccgctaccggcgccgccgccatgtctcctcgtcggacaaacaggaagcaagcggcctcggggccgcggagatttctacggggcggcggaggggtcgccgcagcgcccccagtgggccgtcggcggaggcgcaagccgcgtggcagggaccgtgtgcggcgtggaggctactgggaattgtagtcctgcgcggcagcggggtaggtgggaaaagagatgtggcctttcctgcactgccggtttctctggcccccgggcccagcatttcggcgaaatctcccaaggtccacattctcccatttctctcgccgatttgggcaggatgcaggcagctggccaagaaatgatcctgggcttcaggtcaggagtcaggccctcgagtccgcttcctgcctgcttctctctacacgtgactcaccgcggacatcgaccaagtcatcgcgctctgccactgcgcctgtgtcctcgtcaggtcactccatctatagattctgggagcctgatcaatcgtagttcctggggctttctctgcgcccgacaccaaaccatgtctaggggaaagggagggtgtctgggatacagtggtgagcagaacggcctgggatcctttatcacgaaatgcaggttacaggggaagacagcagatccatacacaaagaaacgcagtctcaaactggataagttgtgtaactgggtaggttgttgtgaaattaaataatggaagggaaagggattagtaaattgtgacatcatattctctgtcagatgaaaaccctgtcctaatttctatccaccagatagcatgttgtctctaatactcattttttcagctaacttctgtggcaggatggcactgactccccccacccaacacacacacactttttcccttcctagcagggggcctgtaataaaaatgaaagaggagagctaagtgtgatgtaacagggaatggtgaagattgtgactcataactaagatgactgtaacttactgctcaaaccagaacactttaaagaatgaaaagacacaataaataattacaccgggacggtaggcataaaagtgactctcccaggtgaactggcactatggttaccatcctcacaccccatctaaaaggagtagactcaccatccatcttcatagaactagaaaaaagaatcctaaaaatcatatggaaccaaaaaagagcctgcatgtccaaagcaagactaagcaaaaagaataaatctggaggcatcacattacctgacttcaatctatacaataaggccatagtcacccaaacagcatggtactggtataaaaataggcacatagaccaatggaacagaatagagaacacagtataaaaccaaatacttatagccaactgatcttcgataaagcaaacaaaaacataaagtggggaaaggacaccctattcaacagctggtgataactggcaagccacatgcagaagaatgaaactggatcctcatctctcacattatacaaaaataaactcagccgggtgcagtggctcacacctgtaatcccagtggctcacacctgtaatcccagcactttgggaggccgaggtagtcagatcatgaggtcaggagttcgagaccagcctggccaacatggtgaaaccccatctctactaaaaatgcaaaaattagctgggcgtggtggcatgcacctgtagtcccagctacttgggaggctgaggcaggagaatcacttgaaccctggagacagaggtcacagtgagccgagatcacgccactgcactccagtttgatgacaggatgagactccatctcagaaaaaaaaaaaaaaatagccaaagaagttacagtcaggagatattttgttccctatagaaactgaatataacatcttaaaatttgtccctgagtgttgtttcttagaaactcgaacccccaccaaatggatctgctgataggcaaactcagataagggagagctgagaactaaactttgacttctattttttgttataaatttcttcctagggggcctggaggaggacacgaccataagtcagagctaacattcttttctgcagatcccaaatttttagacaaagctttacctccttaaccaattacaagtcagaaaatctttgaatccacttgtgggcccctggttggagatgtcctgtctttttaggtggaaccaatatacagcccctatgtattgatttatgacttcgcctgtggcctctgccctcctgccattaaaaacctgtaagccggctgggcgcggtggctcacacctataatcccagcactttgggtggccgaggcaggtggatcacctgaggtcaggagttcgagaccagcctgaccaaaacggcaaaaccccgtctctactaaagatacaaaaattagccaggcatggtggcacgtgcctgtaatcccagctactcgggaagctgaggcaggagaatcgcttgaacccaggaggcagaggttgcagtgagctgagattgcaccactgcactccagcctgggcgacagagcaagactctgtctcaaaaaaataaaataaaacccctgtaagccataagggagttcaggtcttaagcataagctgtttgattctcctcgcttggcaccctgcagcaagtgcaataataaatgcctcactttctcttgctgtaatcccaatgtcagtggctttgctgcaccaggtaagcagccctcactttggttcaataacaatacttttcataactttttgcaccagctatgtatcatttctagattcaagaaaaaaaagtcttctaatatgtgaaattaactttaaaaagacataaaaagaaaaggcatttccagggatacaaacagggcattggtgagctgtccgggcagcagccagccttaccagggaatccacagcccagggattccacccagagctcttcctgaggcatatggtgatggatattctcacccttgtcgcggtgaggagacaggatcctgactaatttcacagttcacatggccctccaggtttcccttggcactcatcatgctagggacaaatcttcccacctcagctttgacccaactgcaaatgtcactttccattcctcagttcctatctttgtcagtctagcctggcccaggcattcaccaaagctgggtattcactgggtcaaaaatgacaacctcaaattcagtccttacagataccatgtgaccatgaagtaaggggacatgtttccagaaacctctgtggaaagacactcttttccacttcacctctgctctgccagccttttccgtagaaactagctgaggctaggcgcggtggctcaggcctgtaatcccagcacttttggaggccgaggcgggcagatcacgaggtcaggagttcgagaccagcctggtcaatatggtgaaaccccgtctctaccaaaaacacaaaaattagctgggcggggtgaagcgcgcctgtagtcccagctgccctggaggctgaggcaggagaattgcttgaacccgggaggcggagtttgcagtgagccgagatcgcgccactgcactccagcctgggccacagagcaagactctgtctcaaaaaaaaaaaaaaaaagctgagtgtctctcaccaccagagggcgaagtacctctcccaccagaggtctgttgatgtcaattttaatcagcactagaaaaaaaatgaagctcccaaactggctaattttttttccaccgtaatcccaaatggcttaaccaaacatgatgatgctattcagagaacattaactcttgtaaataaatcgccaaactcatctcaattgggcagacagattttctgggacttttttttttttttttttttttgaagtcttgctctgtggcccagcctggagtacagtggtgtgattatagctcactgcagccgccaagctcctgggctcaagcaatcctcccgcttcagcctcccaaagtgctgggattacaggcatgagtcatggcaccctgccaagaagtcactttaatcaaagcaactggcactgttatatcaggccatggtaacagctgtcccatgcaactatgcattgtcctgtggtgtcattttttacagtgatttttttttacattacatttctaatgtacaacctctccatgatttgtcttttaaatgtttgttaagtactatcttatgtgccaggcactgttataggtgctgtggatattgtgctaaataaaataaacaaaatttcctgccctcatggggcttatacttctgggtaagatctaccctttattgagcacttaccattggccaagcactttctttgcactatcttattattctcgcagcatttttggggaagtttttcaaatctacagaaagttaaaagatacaccattaacactcatataccctttgcttagacttgtcagctactaaaactatattttatctttctctctgtgtatatatacacatatatgtacatatatgtgtatatatacatatacatatatacacatatgtacatatatgtgtatatatacatatacatatatacacacgtgtatatatacatatacatatatacacacgtgtgtatatacatatacatatatacacacgtgtgtatatacatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatacacacgtgtgtatatatacatatacacacgtgtgtatatatacatatacacacgtgtgtatatatacatatacacacgtgtgtatatatacatatatacacgtgtgcctatatacatatatacatgtgtgcctatatacatatatacatatatgtgtatatatacatatatacatatgtgtatatatacatacacatatatacatatacgtacatatgtgtatatatacatatacatacatatatatgtgtatatatacatatatacacatacatatatgtatatatacatatatgtatatatacagctctttccatatatgtatctctctctatacttcatttatacgtagagagggtttgtgttagttttgctaaacatttttttttttttagacagggtctcgctctgttgcccaggctggagtgcagtggcacgatcatagctcactgtagccttgggctcctgggctcaagggatcctcccatctcagcctctcaaagtgttgggattacagatgtgagccactgcacccatcctgctaagccattttttgctaaaccatttgaaagtaaattgtagatattatgacacttcacctgcatattttagaatgtatctcctaagatcaaggacatgctcctaaaaactatgataccatcacacccaagaaatttaatattgatacaatttatctttttttaaatttatttatttaagacagggtttcactctttttgcccaggctggagtgcaatggcacaatctcagctcaccacaacctctgcctcctgggttcaagctattgttctacctcagcctcccaagtagctgggattacaggcatgcgccaccacacctggctaattttgtattttcagtagagatggggtttctccatgttggtcaggctggtctcaaactcctgacctcaggtgatccgcctgctttggcctcccaaagtgctgggattacaggcatgaaccaccatgcccaggctttttttcttttttgacatggagtcttgctttgtagcccaggctggaacacagtggtgtgatctcggcttaccacaacctctgcctcccaggttcaagcgattctcttgcctcagcctcacgagtagctgagattacaggcacccaccaccacacccagctgacttttgtatttttagtagagatggggtttcaccatgttggccaggctggtctcgaactcctgacctcaagtgatctgcccaccttggcctctcaaactgctgggattacaggcatgagccaccatgcctggccattatttatcttataatccatattcaaatatctgcaattaccccccaaatgtcccttacagtctcttccccccagtccagagttcagtaaaggatcatgcatacatttgaaagctatgtcttgtcactgtcttttaatctagaagagtccctcatctcttttgtcctttcgggatattgacagttttggggtccgggccagttgtactgaataccctgacatctggatctgctttattgttttctcatgatttggttaggattaagcttttatggctagaatattaaacaggtgatggtgtgtctttcccattgcttcatatcagaaagaaataatgtaaatgtgtcccattattgatgatgctaagtttgatctgttggatcaaacttaatatgtcttcattggaaacatacattttggggttaataagtaatctgtggccttcaagactacgagactgtcttgttctccacccacctttcacccagtaatgtttgtgtttgtttgttttgagatgaagtctcgctctgttgcccaggctggagtgcagtggcgcaatctcggctcactgcaaccttctgttcttcttctcttgcctcagcctccctcccgagtagctgggactacaggcacgagccacttcacattgcaagttttgcttttttttttttttttttttttagtagagatggggtttcaccattttggccaggctggtctggaactcccaacctcaggtgatccacccgccttggcttccgaaagtactgggattacaggcgtgagccaccgcgcccagcccccacccagtagttttttttgttttgttttgggttttttttgtatttttagtagagacggggtttcaccatgttagccaggatggtctcgatctcctgacctcgtgatccacccaccttggcctcccaaagtgctaggattacaggtgtgagccaccacacctggccaacccagtagtttttatcatcccttgatgatccctccctggattatcatgctggtggttgcaaaattgtaactttctaattctaccattgcttcctcttttattaggtaatattcccccccaaaaggagctcccgccctttttctggggtatcactatggactcataaacttttttttattttatgtgttataatccattactatggttattctattttcccttggttttattagggtatcatttacataaaatgaaatgcatagatattaggtaatatgtaatctgatgaattttgacatatgtatatacttgtgtaaccaacacctgaatttaaccaatactcccaatggatatagaaatttccattactccagaaagttctcatgcacttgttacttactaactccaaaggagaaaaatgtacctctccactgttctaattttatcatcatagattaattttgactgttccataacttcctataaatggaaccatctaatatatagtcttttgtgtttagcttttttcactaaggatgatgttttctagattcatccatgttgatctgcatgtcagtggttcattcctttttactgctgggaagtgtaccgtctcaggaaatgatagtccagggccgggtgcagtgcctcacacctagaattccagcactttggaaagctgaggtacaagaatcgcttgaaaccaggagtctctacaaaaaattttaaaatgagctgggcttggtggcacacacttgtagttctagctacttgggaggctgaggtgagaggactgcttgagcccaggagttggggtctgtagtgagctatgatcccaccactgcactccaacctgggtgacagtgtgagaccctgtctctgaaaaaataaaaaagaagatgataccctaagataaaggcttcagaagcagctctctctgaccgtctcctgcccttctgtctctggcctcttattctcccctgaggctagtcatagaaactagaatccctcttccccaaggcagggtttagaaaccagaaactggcagggcgcagtggctcactcctgtaatcccagcactttgggaggtcgatgcaggcggatcacctgaggttaggagttcgagaccagcctggccaacatggtgaaaccccatctctactaaaaatacaaaattagccaggtgtggtggtacatgcctgtaatcccagatactctggagactgaggcaggagaatcgcttgaatgtgggaggcggaggttgcagtgagccaagattgtgacactgcactccagcctgggcactagagcaaaactccatctcaaaaaaaaaaaaaaaaaaaaaaagaaaccagaaaccttcctccttccccttgccagcggtgaaaccaaacctaaaaatattactctaactccctccccctaaaccaccacacctttctgtgcataaactggccatcaagaaattatccaacctacctggtttgactgtaggtcataagacccccattccagagagggtcctgctgcacacccggaaggaaggacaagaacaaaactctgtctcaaaaaaaaagaaaaaaaattctgtgtgtgtgtatttctcattctttttgatgctcaaattgtcccaaatttgaccattggtagtcctctcaaattaattcctgtgtcatctttgggacaatcttaattttaaatgggccctgtgggacttaaacttgtccaacactatgatcggttctgagttcagaaaatagtctctctaaatttttgttccaatctccacagatgtagattcttacctcattcccaaagctagtcactccttaatctacaacagccattcttcagcaacactgaagactcttatgacataaagttgaaacttctttccccaaatgatgcatgcatccgacacacaggcagacacacacgtgcatgcgcagacacacaggcagacacacacgtgtgcgtgcggacacacaggcagacacacgtgcatgcacacacacacacattttgccagtggttcttggattgtttacagtgatctctaaatcactgaacgcctactatgtattagagattgtgctagatgcaaagaaatgcaaagggaagaaaataagaaaattaacatttaaaaaagacctaggccccatgtggtggctcacacgtgaaatcccagcattttgggaggccaaggcaggagggtcacatgagcccaggagttggacacaagcctgggcaacatagtgagacctcatctttacaaatatatatatattttttaattagcctggcatggtggtgcatgcctgtggtcccagctagttgggaggctgaggtgggagaactgcttgagccctgggggccaaggctgcagtgagcagagattgcacagtccagcctgggcaacagaacgagaccccgtctcaaaaagaaaaagaaaatacctaccatgtatgttccggacattgtactaagtgtttgatacatgtcatcttaacaaagatgcataaaatagagatttcataaactaacaaattatcacagcacactagaatacatactattgtaaataaaggcatgtagtcactgaattacattcattcaccagatatttcttgaaaacttcctatgtacaagctctgccccaggcgtgggggatacatctgtgaataagacaaatgcagcctgtgccttctagggctcaagtctagtggaggaaggcagacacataagcaattaccatcagagctccaacccacacaaacatttttaaaaacatattattgtagagacaggttctcactatgttgcccaggcttgtctcaaactcctggcctccagcaatcccctcacctctgcctttcaaaacattgggattgcaggcgtgagccactgcatctaacccaaaaatatgtttcaaaaagaaaaacaaaatctaaaacccactgcctctgaatctgtactatattctttggaagctcctcacaggtgacaaattagcattgtcttatatacaacccaaagccctctgagcagagcttgatgaataagtggataattaatatcttttttttttttgagacagaatctcactctgtcgccaggctggagtgcagtggcatgatctcagctcgctgcaacctccaactccctggttcaagcgattctcctgcctcagcttcccgagtagctgggattacaggcgtgtgccaccatgccatgcccagctaatttttgtatttttggtagagacagggtttcaccatgttggtcaggatcacaagctcctgaccttgtgatccgcaggtgcagatagaaaagaaatcccagattgagtgttgtgctgtaatcctagaaaacaatcgatcaaatcagaacagactccatgaataaaaagaagagattccaaccagaaattaatgtcagaaatttgaaaagggaatatcatttcagattcttcagcaccaaaagatcataagaagacatgatgaataactttatgcctatgtatttgaaaatttaagtggaacagaaatatttctagaaaaaagtcttacctaaatggacacaaaacataatagaaaattggaatcatcctataactattaaagacatttcatctctaatttaaaaggttcccacaaagaaaactccaatccctaatgcctttgaaatctaccacacttttaaggaagaaataatgccaacatcacataatttcttccaaaggccaggaaaaaaggtcaccaaccgacatgaaagcaacataacattgacaccaacataggagataaggtgcaaaaatatctctaatttcatttcattcagttcaaaccgtgatacagtttgcctgtgtccccacccgaatctcattttgaattgtagttcccataatccccacatgttgtgggagggaccgggtgggaggtaattgaatcatgcgggcagttacccccatgctattctgatcatgagttagttctcacaaaatctgatgattttagaaggggcttttccccccattcgcgcttcacttcttgctgctgccaggtgaagaagaccttgtttgcttccccttccaccatgatcataagtttcctgaggcttccccagctatgcggaactgtgagtcaattaaacctctttcctttatcaattacccagttttgagtatgtctttattggcagcgtgagattggattaatacaaactgctttcattaataaaattgcatcaatttgttgcagcaatgttgggaacatctagtacccttgttctcagtcttgagcttgcattagaatcacctggaggggttggctttgttaaaccagattgggggcccatctgtggtcagggatggggcccaagagttttaaatacaacaagatccttggtaatgctgttgcctctgcaccagggaccacttttgacaatcactgacccagtggcacatactattttgaaatcttgcttgccatagaagtaatgttatttggaatgcttggacaggctcagtatgttggaacaacttctaatttaattctctaaggatgtaaaaaaaaaaatcttggttagattggccaacattgatatgattggccaatttcaatatgctaaagtaaatgatgtggtcagctgtaatccctgaaaatttgttttcaagaagttgattatcactgtttttcccccaacatatatatgaattttagcaggatccctttgttttcctaagatttacagcatataaaagagtattccaaatagcattgctttcagattcttctaacaattttataataactgtattatattttcattcatatttgctactctcatacaatgtctttatatttgtctggactaatctgtattggccaaagttacaattgtcaattctctgaatgcttttaatccagttttgtgagagaagattaaccaaacaagaagaccctccttaaaatgttcttaccactcatgtaagatataagctaagtgttgtgcaactttcaatttgactttctctggttggattacaaaatctatacgagattgtaacagcataataagcattgtttccaacattccgcaacagtatagattcaaggagaaactctattattgctaaggtatgtttttatggcttgctacaccataaaaactatacacaccaaaatacatgccagagaataaatgtttttttcaggaaccatgtgagcaatttttttcttttggcacataatatgcaacccaatacaatgataataaggctttctcactgacagtcacaacatgaatcataaaatttgcctatcacattatatatgtttttctttctttggaaatattcgagagactgactaattcaacatgtcatgtttccaagcatcttttaagttttgatggttttaagttctcatttgcaagaacatcattataatgcattggtgtacatgtcattttgttggttttacacatttcataaaataatacacacatatatgtatatatatatatagagagagacagagtttcataattatcacccagactagagactgtgatctcagctcactgcaacctccgcttcccgggttcaagtgattcttctgcctcagcctccagagtagctgggattacaggcgcctgccaccacacctggctaatttttgtatttttagtagagatggggttttgccatgttgggcaggctggtctcaaactcctgatctcaggtgatctgcctgccttggcctcccaaagtgctgggattacaggtgtgagctggctgggcatggtggctcatgcctgtaatcccagcactttgggaggctgagatgggaggattgctcaaggctaagggtttgagaccagcctagtcaacatagtgagacccccatctctattaaaataaataaataaatacataaataaagcaaatcttgcatttaccctttttaacaagatgcaaatgatgtcagtctgttgattagagttgatattttctccaatatttccatttactcttcccatgtttttcaccttattattcttgttctttgtagcattaaaacagtcaacttaagagcaatttgaactagttcaattaaaatgctacaattattgcacatccaaaattttttatctgattataaactttctgaaaaactgcactgcaaattcctaaccaaaactcagttgaaagtcatggcaatattgcaaaaaaaaaaaaaaaaaaaaaaaaattccactcttcaattcacaactaactacaaactattttgatataaaattaaataatacacagctgggtgtggtggctcacgcctgtaatcccagcactttgggaggccaaggcgggtggatcacgagatcatgagttcaagaccagcctggtcaagatggtgaaaccccatctctactaaaaatacaaaaattagccaggcgtggtggcaggtgcctgtaatcccaactactaggaaggctgaggcagagaattgcttgaacccgggaggcggaggttgcagtgagccgagatcgcaacaccacactccagcctgggcaacaagagcaaaactccatctcaaaaaaaaaaaataaataaataaataaatactatactattctgccattataacttgatggtcatattgacactcatgtaccagaaaatcaaatgagatgacaattcaccaaataaactgcttttagccaacgtgcacatttttcacatcccctcctctgtctctcccacaatgtaatgcaattagccttgtgcgattagtaatgtgctcctgtcctcagttcttgtcaagaatccacacaaggcactctaatattttcgaatccattctatttcattatttaaaaagttagtgggacacattaaatttatttcttgacccactaaagggtcatgagcaaagtctcaaaaacactactgtaagacactaaactattaactattgcaagggagtttgtaaaaaatacaataaacagaatagcttacctctctgcatgcagaatgttttctttgctaactttatttttcaaggctggatttataccacactgggcttgcaaacttgctgcttcatgggttggtggggaggggtaggagaggggtgtgtggggtatatatgttttcttttttattttatggtctttttaaaaaattgagatataattcatacaccataaaattcacactattaaagtacaattcagtggtttttagtatattcccaatattgtgtaactatcatcactatctaattccagaacatattaatcacccatcaaaaaaatccatacccatgaagagtaactccccattttccctgcccctggtccctgccaaccactaatttacttcctgtctccatagattaatctattctagatattttatataaaaggaatcacacagtatgtggccttttatgtctggcttcttccacttagcatatatttttaaaggtttatccacgttgcagcatttatcagtaggtcattccatttagtggtcaagtaatatgccattgtatgaatattccacattttaatcatttgtaagttgatgaatgctaggattgtttccacttttagctattatgaataatgctgttacaaactgacgtacaaacttttgtgtagacgtaattcattttagttttctcttgggtgagtggaattgctgggtcacatggtaacttaatctttaattttaattaatttatttataggctgaagtgcagtggcgtgaccttggctcactgcaacctccaccccccagattcaagcaattcttctgcctcagcctcccgagtagctgcaattacaggcgtgcgccaccatgcctggctaattttttgtatttttagtagagacggggtttcgccatgttggccaggctgggcaatgtttaatttttgataagccaataaagtgttttccaaaccagctaccccgttttatatccccgctagcaatggatgaaaattccagggctgggcgcggtggctcacgcctgtaatccagcactttgggaggctgaggcgggcagatcatttgagcgcagtagttcgagaccagcctgggcaacgtggcaaaaccctgtctctacaaaaaataaaaaattagccaggcgtggtggcatgcgcctgtggtcccagctacttgggaggctgaggtaggagtatcacttgagccccagaagtcgaggcttcagtgagctttgattgcggcactgcactccagcccgggcaacagagtgagaacctgtctcaaaaaataataaataaataaataaataaaaattttaaaaacaaaattccaaattctccacatcctcactaacatctcccacctcagcctccctaaaagctgtgactacaagtgcgagccaccatgctcagctaatttttttatttttggtagagacagggtttcgccatgttacccaggtcttaaactcctggactcaaactatccacccactttggcctcccaaagtgctgggattacaggcttaagccactgttcctggccttttttttttaaataaatgatttttaaaaatttttatattgacaaggctgggcgtggtggctcacgcctgtaatcccagcactttgggaggctgaggcaggcagatcacgaggtcaagagatcgagaccatcctggccaacatggtgaaaccccggctctactaaaaatacaaaacttagctgggcgtggtggcacatgcttgcaatcccagctactcgggaggctgaggcaggagaagcacttgaaccagggagtcggaggttgcaatgagccgggatcgcgccactgtactccagcctggcgacagagacttcgtctcaaaaaacaaacaaacaaacaaaaaaattacattgacaaataaaattagtatatatttatcaagtacatgttgttttgaaatatatatacattgtggaatggctaaattgaggtaattagcatatgtgattaactttagactttaaggatatgtactcgtcataatggtctctattagccaggaacctgacaggaaacagatggctcattcaaattagaaaaattagtggaaggtttaataaagagactacttacaaaggtgtggacagagtgttagagaaccgcaagggaaaatacagtaatcctatacagccaatcctatccctagcctgaagggaataagagaatggttactgtattagtcagaattacaaaacagaactaatggaatatgtttgtgtaaggagggcgaggtggcttacacctgtaatcccagcactttgggaggcggaggtgggtggatcacctgatgtcagaagttggaggccagcctgactaacatggtgaaacctcgtctctactaaatacaaaaaattagtcaggcatggtggcaggtgtctgttatcccagctacttgggaggctgaggcaggagaatcacttgaacccgggaggcagaggttgcagtgagccgagatggtgccactgcattccagcttgggcaacaagagtgaaactccatctcaaaaaaaaaaaaaaaaaaaagaatatgtgtgtgtatagaaagaggtttatcataaggaattggctcacacagttgcagagattggcaagtccaaatgtgcagtgtgggctggcaggtttgaaacccaggaaagccagtggtatagatgaagtcccagagcgggctgctggagaattccctctcatgtaagggagaggccgtctcttcattctcttcaggctccagctgattgaatgaggcccatccacattatgaagggtaatcttcaccaattaaaatgttcatctcatccaaaaacacccttgcagaaatactcagaataatgtttgaccaaatatcggagtacccagtggtccagccaggttgacacataaaattaaccaccacctgaaaataaaaagttgtgtagagatgggcaccttgggataaaatgatactttttttttattattgtactttaagttctagggtacacgtgcacaacgggcaggtttgttacatatgtatacgtgtgccatgttggtttgctgcacccattaactcatcatttacattaggtatttatcttaatgctatccctcccctatccccccaccccaccacaggccccggtgtgtgatgttccccgccctgtgtccaagtgttctcattgttcaattcccacctatgagtgagaacatgcagtgtttggttttctgtccttgcgataatttgctcagaatgatggtttccagcttcatccatgtccctacaaaggacatgaactcatcaaaaggatattctttttatatacatatatatagagataggatctcactatgttgcccaggctggtcttgaactcctgggctcaagcaatcctcccatctctgcctcccagagtgctgggattacaggtgtgagtcaccatgcccagtcagaaatgataccttttgattgagagatgtagccagcctgaagcaaatcctgcaagaagggagccagagggataaacgcccttgaactcactccactccctttcaccagtctcctgtctgggctccccactggatgaacccaactggaagccaggaagaatgagcccattaattgtagctcataccagaccacgagaacagaggataatgaatttcttggggcaaagaatagggtgaaaaagggtgaaaagcacatccacagggggaaatggaagatatcctacacacaagattatgccacagtaataagcaattccagcggactcaaagaaagtagaaggaaggaaataagatcaaagcagaaattagcacaacagacaaacatacacttgacagcaacaagtcagtcccaagtttgttcttcaaaaaagagaaatacaataagaaatatctggcaagactaatcaagaaaaagagaaggcatagataattaataataaaaaacaggccaggcatgatggctcacacctgtaatcccagcacttttggaggctaagtcaggaggatcatttggatgccaggagtttgagaccactctgggcaacatggcaaaaccctgcctccacacaaaaaatttttttaattagccaggtgtgatggtgcatacctggagttccagctacttggaaggctaaggcaggaggattgcttgagtgtgggaggtcaaggctgcggtgagtcgtgatcacaccactgcactccagcctgggcaacagagcgagatcttttctcaaaaaaaaaagaacaaaacagataggacaacttcatgccaatgaattcatagaaaagtacaactttctaagttagggaagagcagggtttaggaaaggactttctttcgtctctctgatctggcctggaatccggggtgttgactaatgatcaagggtatccctgggtgtggggatgagctggccttggccacaaagaagcctgaataatgaagtggactgtggttctaagagtagtcatagctaatagtagctgttagctagtagatgatgtaatttccttccattatgcctcagttttcagtcaagacttcttcaaagttatagcagttctcgtctaggttatggggaattatgtgtaggcctgagtctctatttgaggcaaagtaatagaagagagggcaggaggtatatccctgcctatcaaggtagccagaggtttgccatggtactgaagaaaatgatcagcagctgaattagccaaggttcatgggcaaagatgaggctggcagataaagccagacaaattcctggttaaaagtcacctcctgagctatttagagaaacagttgattcagggctgggataggaacgggatcagctgagcttggaacatcttgtaataccagaaagcaggacactatcaaagactattggggttgtgttaacaggactcagggctaacttgaagagaggcttccactggccagaaatgggacaatttgagctttgataagaaaaataatttcaatgaactgaaaaccatcaaatgagtttaaatccaagagttcacaatacttgaaaaacaaaacttcattgtcacaattggaagatgctaggaaaatgatgcattattctggaaaataaaaaataaaagttaagaatcaaatatttatcctggctttcctgaatgaactgtgccccaaggaacccaaatagttgacgagaggaagtctttctttagagaagtagtctagccttggctgggcatggtggctcacacctgtaatcccagcactttgggaggccaaggtaggtgtatcacctgaggtcaggaggtcgagaccagcctgactaacatggtgaaaccttgtctttactaaaaatacaaaattagctgggtgtggtggcgcatgcctgtaatcccagctacttaggaggctgaggcaggagaattgcttgaacccgggaggcagaggttgcggtgagccgagatcaagccattgcactccagcctgggcaacaagagcaaaacttcatctcaaaaaaaaaaaaaaaaaaaaaaaaaaagagaagtagtctagactaattaaaatctcactattttgaaacccctgttgaaataatggatccaagcaatgaccaacaaatggctgttagtaacaggcaaggagacatcatgtgtctcttgaccaaaagaaacaacagtgcttattcttgaaaaataaaaacaccagcctagacaacatagcgagaccccatctaaacaaaaaatttaaaaattagccaggtgtggtggtgtgggcctgtagtcccagctattcgggaggctgaggcgggagaatcacttgtgcccgtgaggctgcagtgaactgtgatcaccccactgggtgacagggtgagacgctgtctcaaaatacataaatacacaaataaaaataaaaacaaaagtaaaaatccaaatctgatgatgtctctagatcttaatatcaactttaaaaaacagttatataataaatacctcagagatgcaattaacaaaatccataatatggaaacctacaggacatacaactgttgtcttcaacaaacaaactgcaatgaaaatagaggaggagtgggaaaggagggagggagggagagggaaagaattcctgtaaattaaaagacatttcagagatatatcatctaatttcaaatatataaatcaaccctatgtgggtcctgatgcaaacaaactataatacaaagttatgaaacaaaacattttgaacattggagaggatatcaaggaataatgatttatttttataggcatgctttggggatgcattctgaaatacttttaggaataaaatgtttggaatcctaaataatctagtgtggatataaatgaaataaggttggccatgaattcatcatctttgaagctagtttgttgaaattgggtgatgagcacacaaaggatggatgtcctgttcgctccatttttgtttatttaaaattttacttagccaggcatggtggcatgcacctgtggtcccagcttcttgggacgctggggtgggatgaccgcttgagcctgggaggtggaggcttcagtgagctcagatcatgccactgcattccagccagggcatgagtgagatcctgtctccaaataaataagaaaataaataaaaataaaataaaataaaataaaataaaaataaaaaaataaaaaataaataaaataaaataaataaaaaataaaataaaaaaataaataataaaaataaaaaaataaacaaaataaaataaaatagtacatcctggccaggcacggtggctcatgcctcctagcactttgggaggccaaggcaggcagactgcttgagctcaggagtttgagaccaccctgagcaacgtggcaaaatcccatctcaacaaaaaatacaaaattaggaaaattagccaggcatggtggcatgctccagttgtcccagctactcgggaggctaaggtgggaagattgcttgagcccagaaggtcagggattgcaaggcttgcagggcttgcagtgagccgtgattgcgccactgcactccaggctgggcaacagggtgagaccctgtctcaaaaaaaaaaaaaacaactttgtggccagggacagtggctcatgcctgtaattccagtactttgggaggctgagatgggaggattgcttgagcccaggaattcgagaccaccctgggcaacaaagcaagatcccatctctaatgtttataaaaatgtaaaaagaaaaaattaaagttacaagaaaataaaattttaaaaagcaataaaattttacataattaaaagctcacgtcctcagggaggctttttccacccaccctatctaaagcagcttatctttccccattattttctagcacagccccgtgttttcttcatggaactgatcacaatgttactttatctatttactaggttatttctttctgctagaaatttagtttcacaagaataaaaactgtttgccttgtttgctgctgaacctctggggctgcggctggcacacaaaggtgcctgcccagccccatggctcacgcctgaaatcccagttaatcaggaggctgaggcaggggattgtttgagcccaggagtttgagatcagcctgggcaacatagggagacaccgtctctgcaaaaaaatttttaaaaatcaggcaaattatagtggtgtgtgcctgtggtcccagctactccagaggctgagatgggaggatcacttgagcctgggaggtcgaggctgcagtgagtcgtgatcatgccactacattccaacctgggtgacagagggagaccctgtctcaaaagaaaaaaggtgcttaataaatcttcgttgcttggaaggacaggtggatagataggtcaactaaagagtaagaagcagccggggcatggtggctcacgcccataatcccagcactttgggaggccgaggcgggtggatcacctgacgtcaggagttcgagaccagcctaggcaacatggtgaaacctcatctctactaaaaatacaaaaaataaaaataaaaataaaaaaattagccagatgcggtgtagccagatgcacgcctatagtcccagttactcaggaggctgaagctggagaattgcttgaacctgggaggcagaggttgtagtgagccgagatcacaccactgcactccagcctgggtgactgagtgagactctgtctcaaaaaaaaaaaaaaaaaaaaaaaagtaagaagcacatgttggagcaagaactaacaaagaaatacatttatgacaacactttccacaaagacaccagaaaaggaagggagattcaactatcgacccctaggatctttggagccagctaaccgcatttagccgtctctccagctgcatgagaaaattaactagagtcacaattgcccgtagccaccaatcctttctttgaatgaaatctcatgagacagcccaatatgtaaaacatgataaccaaaatatgatagccaaaagcaatttattatagtttagcctcaaaaaaataaaaataaaaaaattatccagtggttatgaggagtctaggaaaacctgtcccagtaatgccaacttggaggtgaagggctgactggggcagctgagaagtgggaccttctgtttggcaggcttcctctcccttgcctggtcatggttttctggtgagaagagtgttcctggccttgctggaggttcccatggccccgaactaacagtgtttttctgaaatttcgacctgctccgtttgagagagtagaattccctcatcaagtcctccacctcccactgctcttccttcagcctctggcagcagtgcagggcggcagggtcgatggggtgagcttctgtgttgaagatgtaccccccagcccccaggatgcactccccatagggggtgatcaccgcgtcgaaggtggacccattgttgtggatgaagttggttgggtcaaacaggaggtagaggtatttcacagtctcggccaggaagaacgactccatgcggttgtccagcttgtggtctcgcagatctttgatctgacatgtgggagaaggaagcaagctggaacaccatcacaatttagtagtaagggtcaggcaatcccttaagaaggcctgttctgccacaaagcagctgagggcctgtgagcaaatcactgaacttttcagaacttcactctttcccaagccaccatcatctctcacctggattatcacataagcttccaaatgggctcccagcttccaatcttagccctgcagtttatatacacacactattttaaaaaatagggacagggtctcacaccatgttgcccaggctggtctcaaatccctgggctcaagcaattcctcctaccttggcctcccaaagtgccaggataacaggcgtgagacacacaccaagctcctacagtatctgtataacataagtcttcctgtcaattctctactcacaactttctgtgagccctccatttcatgcaggataaaaatgcaagtcatgacctggcccctgctcccttcctgccctcacctcttaccactctaagagctccagctgctgcctttctgtcctgagctagcacagcaccctcctgcttcgggctctttgcatctgtggttctttcagcctggagcactccgcctccagtttttctcatagcttgttccctcccttccttcaggtctctgctcaaatgcttcctcaccagaaaggtctccgctaaccttgctctatgacatgacaatctcctatcccctttatcccaactttttgtgactataaacatagagctaatcgtcccttttaatgatggcagagtattccatcgtgaaaatggatcaccatttacttggctaatcctccttggaagggcattcagatgattaccaagtttttttttttttagagatggagtttcactctgttgcccaggctggagtgcaatggcatggtctcggctcactgcaacctctgcctcccgggttcaagcaattctcctgcctcagcctccagagtagctgggactacaggcacatgccaccacacccaggtaattttttttgtatttttagtagagacagggtttcaccatgttggtcaggctggtcttgaactcctgacctcgtgatccgcctgccttggcctcccaaagtgccgggattacaagcctgagccactgcgcttggccaattaccaagtttttgtaagcaactaataaggggtctttttttctccactcagacccaaagtatcgacacttactaggttcaactgctgttgatgaaaactattgacattgttttagtaaggagtcttatttagagaatttcaactgagttttcaggcatggatgactaagattacttgctacaaacatttattttagcttctcagaattagtaatacttctaaacaaaacattctcagtggactctatcttacatttaaaaatatgactcaaatatggtcttgatgtatcaagatgattatttccttgccctgtttgagaaaggtcagacccctgttcccatcattcaccatggaagacctccaaagggcttcatgttcatggaaatgagcccagcattcctaggaaggccccagtgggcttatcattttggtttttcacacaatacagcatattagaaaccaaatcatatcaggggtttattttttcccttccacatgtaggtcttctctcttcccctacacatatctatattttacttatagaatataatcacattacaaacttttgcaaaataagtgttttgttgttgttttgaattccataccccaacactgtaggcttttcaggggattttcttccagactattttcttctactttcatatttatatcttgcctgcttggttcctgcatggatgtgagatggctctcacctttgaccctttcaatctattcttcacaaagcagccaaagcgatctttctaaaatacaaatcagatcatgtcactgctctgctgtaaatcctaccaagggttcacattccaagtagaaaaaaaaacccaaactctttcctgtggcttacacaaaaccctacatgatctagcccctgcctacctctgggaccttatctcttcccacttttctccttgcttgctccgctccagccacactggccttctgtctaccagatacacattcatggtttttttctcattaaaatgtaagctccatgagagcaaggccactgctgtaacccttgggcctagcagagtgcctggcatgtgaaagacattcaagaaatatctgtgagactaagcaggactgctttgttaaggagtcccaggtttgaatatagggctatgggactctggattccccttaaaatctattttagtgtctcacaaaacttttcgctaaactcaccttttcaaagtcacctattcaaacagatcaaagatctccactgtgggaggaatgccaagggccggggtcaagatcccaaggaactaattctagctctacctctactagctgtgagatctttagcaaggcacttagcttctctgttctttggtctccccatctgtaaaatatgagcattatgtatatctccaaggtcccttctagtgctgatatgtcagaactcccaaagctctacccttaaagaggctttttagcagcaaggggagactcttcccagttcttggggccatgcaaacacttactgttgcaaatccgcactccaccttgctgattttttcaatggattccacagcatctcttccgagttctaggagggtgggatcccccgtggcacggtagaggtacattgcgctttcaataagttctgcaaagtccaaagcagaccctcctcactcagtggctgcacagagatggcctggggcctcttagggccgtgagggactactcccctccatatcttgtccataaggccccaactagcaggaacacaggatacctcacccagtgctgagtttcagagccagtatacccaaagcttgaagctcagtggagaccagcattaaggctgaccagtgacttccaccacaagggagagaaaggtggccaggttctggcatagagaaggtggcggaggttgttgcctaattcccaatatctgttccccgcttcctccttagtagcaggattcctaactttagctaagcacaggctgcctggctgccaacactaactattctaacagctaggtgggattaaggacaccatggcgagccatataagcccagaacatgagagagaaatacatttctatcctaattaagctactattttttttcctgtcactcagagtctaacctaattctaaaactcaaaagaagagtaagagcttggcatcataaggctcgttctaagataggatggaccaaaagaaaaggctgagatatccaagagcaggccaggcatggtgggtggctcatgcctgtaatcccagcactttgggaggccaaggtgagaggatcgtttgaacccaggagtttgagaccagcctgggcaacatggcgagatcttgtctctacaaaaattaaaaatgattagctgggtgtggcatgcacctgtagtcctagctactcaggaggctgaggtaggaggatcacttgagcccaggagtttgaggctgcagtgagccatgattaagccactgcggcactccagcctggatgacaagagtgagaccttatctcaaaaaataaaaattaaaaaaataaaataaaataaaccaccaaaccgtcaatctaacaaagacgtagtcatcagttcactgtggccagaaaaagtgatgttttgtcttgcccaattctatgccacaactggaacttgatgttaagacatgagctctaccttaagatgaatattagccaacaggagtgggtccagatgagaatatttattctagagataaggaaatccaaaaaaaatgtgtttattgctttcaaatacctgaagaactgttgtagagttgacttcaagggtggcctcagctcagtatgtttttctacttcatccatcttttctaagagacagaagaacccctgtctcctttctataccatcatctccccctgaccttctcctgtcctgtttcctcctgggcttgatcagtgcttctgtcccttttggcttattgctgcaaactctggttcttattttattccgttaattacttttttgtgacagagtctcactctgtcacccaggctggagtgccatggtgcgatctccgctcactgcaactctgcctcctgggttcaagggattctcatgcctcaacctcccaagtagctggaattacaggcatgcgccaccagccctgactaatttttgtatttttagtggagacagggtttcgccatgttggccaggctggtctcaaactcctgacctcaagtcatccgccagtcttggcttcctgaagtgttgagataacaggcgtgagtcactgcacccagcctctagttcttattttagagaaaaggtctctgcctatctccccagttctctcttacttcctcctcccctctcctcacaggcctctagacaattgctaatctaattgctcatattctaaggcacagactagggtacattcattactagatgaacacattctgtgtgttcaaaggcagaaaagacagtgccctcatgggaggcctcctcttctgcttcttttttcggcttcttcttttttttttttttttttttttgagagggagttttgctgtgttacccaggctagagtgcaatggcatgatcttggctcactgcaacctctgcctcccaggttcaagcaattctcctgtctcagcctcctgagtagctgggactacaggcacatgccaccgtgcccggctaatttttgtatttttagtagagacagggtttcgccatattggtcaggctggtctcgaactcctgacctcagttgatccaccgccttggcctcccaaagtgctgggattacaggcgtgagccaccacacccagccctcttctgcttctagcagctggtgggccagtgccctcatgaccagccatcacgcttctctcctcacatgtgggcctcctaagcatgttagttattgctttactttcctgtgcatctgaccaactctgtcgagcagtggtccccaaccgttttggcaccagggaccagtttcatggaagacaatttttccatgaactgggcttgtaggagatggttttgggataattcatgtgcattacatttattgtgcactttatttatattattattacattgtaatatataatgaaataattatacaatccaccataatgtagagtcagtgggagccctgagtttgttttcctgcaactagacagccctatctggggttgatggatgacagtgacagatcatcaggcatcagcttctcctaaggagcacacaacctagatccctcacatatgcagttcacaatagggtttgtgctcctatgaacgtctaatgccaccacggataagacaagaggcggagctcaggcagcaatgtgagcgatgaggagcagctataaatatagatgaagctttgcttgctcacacgcagctcacctcctgctgtgtggcctggtttctaacaggccatggacttgtaccggtccacggcctgggggttggggaatccctgctctagaggaaggagacagcccaaagttcagatttggacttagaggaaggtaaaagcctgcagaggcctttaggctaggctctgtgctccaacactgctgatcagagagacatatacgaaagtacagggctctggccaatttagtgaaagagtagtccttatctcctatttgccattgttttggggtaggagggatgactggattaacgcactcctggattcctgacagcggtgccttatgttttttttttttggagacagggtctcactccattgcccaggctggattgcagtggcgccatcatggctcactgcagctacgaccacctgggctcaagtgatcctcccaggtagctgggatgggactacaggcatgcaacaccactcttggctaatttatttatatttcttatagagacaaggtcttgctatgttgcccaggctgatcttgaacccctgggcttaaatgatcctcctgcctcaggcttccagagtgctgggattacaggcataagccactgcatctggccagtagtgtcttactttccatgaatgccttcctgccagcctgtcccaaatggaacaggttgcctctgttaagtagcaagctccttgtcactcgtggtaactaagcaaaaactagataaccacttgacagggccatattaggaaaattccaattagaacacctctcaggttccctctaaccctaagattgtgcaagcctatgtcttacatttagttccaaaccctaatctttacctgttggtaacaccagatacgataccttctcagagcttcttatttttaaaatttacttatttatttttttgagatggagttttgctcttttttgcccaggctggagtgcaatggcgtgatctcagctcactgcaacttctacctcccgggttcaagcgattctactgtctcagcctccccagtagctgagattacaggtgcacgccaccatgcccagctaattttgtatttttagtagagatggggtttcaccatgttggccaggctggtctcaaactcctgacttcaggtgatccacctgccttggcctcccaaagtgctgggattacaggcgtgagccaccatgcccaaccaagtttcctgttttaaaaacatgccatgagaacaaatgcatgagaaacatcaataacagtggcctctaaggagtcaaaagttgatgaatttgctctttattccctctcctggtcccctctacacctcctacgataatcacttgagttagaagaggaaggaaatggggtagaggaaggcaggataaccagaaggcctgtcccatggctaaaaggcaattcaggtgggaaagtgggaagtgtctaagacaatgggctcatagcctgttttggggtgggggatgactatgtgtgctgactaagcttccttcctttgtccctctttttctttccctcctcacaattttcagcttccctgaagtgaatcaaatgacattagggctagaaaggaacctatgagagtgtctcaaatatagtcctttgcttgattctgagctgcaaatggggaggtggaagagactaggtaattcctaaggtccgccccaaagttctaacattccatacacgtaagcataatttatctgacccatggacttaggaagcttgcctacacttctgaaatcctgatggcaggagctcaaaaggagtcaaccttggccttttccttctcactcatttcctgatttgaaagagcatatggggccagtcgcagtggctcacatctgtaatcccagcactttgggaggccaaggtgggcggatcacctgaggctgggagttcaagaccagcctgaccaacatggagaaactccatctctactaaaaatacaaaattagctgggcatggtggctcatgcctgtaatcccagctactcgggaggctgaggcaggagaatcgcttgaacccaggaggcggaggttgcggtgagccgagatcacaccattgcacttcagtctgggcaacaatagcgaaactccatctcaaaaaaataaaaataaaaaagagcatgcaatttagttaggagccctgggttccaggcctagctcctgcacttaagagccagaggcgagccatttcatcccactaggcctcagtttccatatctgaaaacatggggataattaactcctagtaagaaaaccacccagagccactgaaaggaacagatggaaagaaatgaacttgtgggcagttgtggaggatggagccttgtagaggggatttggggtttcagcaaccagagcctgtgggcagatgacaagccagaaatgctgctcacctggccgaagtgggtagccctctcgcttctccactgtgtatccctgaggaatgttgtagaattccgggagccccccaaactgcttccatacagtgtagtagttgaggaaggtcctcatggcattgtcaatgtctccaatgaggctctgtgggagaaagtggctgtcaggcaggtagacaccaggcataaaaccccacagacaaccttaagaaaagacaaagtaaaatctgtggggccaaaaaggccttgaatcaatccctgagtctgccagttactcagtgtggtgctgagccaggcactggacttctctgagccccatctataaaacgtaaaatacaccacctatctcatgcattgttggaaggaacaaagattgtatattaagtccctaaatcttcagagtcaatgtcagctaacagttttggaattcggccagccagttaaaaattctaagaatagagaaaagtttgtgctaaggctcactcccacaccacacccccaaaagataaccatttttgtttttgtttttgagacagggtctcgctctgtcacctaggctggagtgcagtggcacaatcacggttcattacagccttgacctcctgggctcaagagatcctctcacctcagcctcccagtgctaatttttttattttctgtagagatgggggtctcactttgttgcccaggctggtcttaatctcctgggctcaagtgatcctcctacctcagccttccaaagtgctgggattacaaccatcacccatcttgcctggcctcagataaacattactggtttcttgtataacctttcagagtttctttatgcatgagtatatgttattttccccacactaaaaaatagcctttggttctttattaatagggatattaattatctccatatttttagatatggaaatttggctttcagatatttttatttgaattggttccaacaactaatgtggcaataaataattctgtatatatgtcacatcaaatagatgtaaaatgttatgtgtaagatacattttcagaattaggatcactgggtcaaaggatatatgcatttataattttaccactattgctaagtagccattactattaatgtaatctcacagggaagcagctgaccctgacatcttcattggatgtctcatggacagaacaaacttggcacttcctaaacaaaattcttggttcccttactttcccacgaaattgcctccctactttggcctttttcccttcttggtaaatgacacaatgtctacctggttattctggatagaaacccggtggccactttttttttttttttttgagacagggtctcactctgtcacccaggctgcaatggcatgatcatggctcactgcagccttgatcttctgggttcaagcaatccttccactgcagtctcctgagtagctgggactacaggcatgtgccaccaccctaggctaattttttatttttatttttatttatttatttttatttttttgagacggagtcttgctctgtcatccaggctggagtgcagtggcgcaatctcagctcactgcaagctccgcctcccaggttcatgccattctcctgcctcagcctcccgagtagctgggactacaggcgcccaccaccacgcccagctaattttttgtatttttagtagagatggggtttcaccgtgttagccaggatggtctcaatctcctaaccttgtgatccgcctgcctcggcctgccaaagcgctgggattataggcctgagccaccgcgcccgacctaattttttattttttgtagagatgaggtctcactatgttgcccaggtgggactactttttcttaaaacttttaaaaacgtagattataaaaacattttggtacatgcactattttggaacaccaaagtggggtagattagataagctctaagatccttccagctgcaactctaccagaccatgtaatggaaaaacaacgagatggcacagcggcacaagctgcttcctgcccttcctgaggcccactgtcaagaatgagattggacagaaacgcccagtggagaaacacctgttgccaatggccattcctgcccagactggaaatgcactgtcgactttaagtactgtaacactccatggcaaactggaagctcagttcctgacactcaatttggcagaactctaaatctatctaattcactctaggtctctcttccatcctcaacctgtccctccaaaaaaagtactcaagcaattaacaaagtacattatttgacttatacatcagaatgagcttgctttgccagactcatagaaagatgatcacattctttgatcattcctacctgaagaccaggccagtaggcctccaaggactggaagactggcatggacacagtccccttgtacatctgaacccacaggtaccagtcatcgaagcgggtgtagttccggatggctttgttatactctgcagtgggggagatgggataatggacatatgagtgattagggagaaaaaaggcaggcctggacagcggaagcgagaacttacactttggaaagagcaccaggatgcaatgaggcaaggaggctagacaagagcatggattctggagtcaaacttccagctcaaattccagctccagctctaccacttgctaaccgtgacctggggtgggtttttcccttttaagcctcagccttatgatctataaaatggggaggccaggcgtggtggctcacatctataatcccagcactttgggaggccgaggtgggcggatcacctgagattgggagttcgagaccagcctgaccaacacggagaaaccctgtctctactaaaaatacaaaattagccaggtgtggtggtgcatgcctgtaatctcagctacttgggaggctgaggaaggagaattgcttgaacccaggaggcggaggttgctgtgagctgagatcgcaccattgcactccagcctgggcaacaagagtgaaactccatctcaaaaagaaaaaagcagaaaataattgatgtggtttggctgtgtccccacctaaatctcaccttgaattgtagctcccatatttctcacgtgttgtggaagggacctggtgggagataattgaatcatgggggccgtttcccccatactgttctcatggtagtgaataagtctcacaagatctgatggttttataagaggtttcccctttcacttggctctcattctctcttgcctgcaccatgtaagatgtgcctttcgccttccgccacgattgtgaggcctccccagccatgtggaactgtgagtccattaaacctctttttctttataaattacccagtcttgagtacgtctttatcagcagtgaaaatggtctaatacagtaatgttaggtatctgtggaatttttcagtcatttatttataccacaaacattcgctaagcacctactaggttccaggctcctatgagtttgtaaacaagacaaaatccagccttcagagaacttacattctagtaggaacttgaatttatccctcatatctctcccctagattgtaaatccatgaggcctgggactttgttttgtctactgcagaatcccccacactagtacaatgagcaataaacattttctgaatgaacaaagtaccaaatatacatgcaaataaataagataatctcaaacaggagttgtaaggattatatgaaacagtccatgttcagagcttggcacaatgcttggtacatccgtggtattcaataaatatttgttgaataaatgagtaaagtagtccccccttatgtgaggagaatacgttccaagaccctcagtggatgtctgaaaccatggatagtactaaataaactctatatacagtcatgtgccatataacaacatgttggtcaacactgaactgtagagatggtggtcctataaaattataatagaggtgaaaaatcaccacagcctaaagatatcacagctgttgtaattttataatgcaatgcattacttacttgtttgtggtgatactggtgtaaacacacctactgtgctgccagtcataaaagtataacacatacaattatgtatagtacgtgatatttaataaacaaccatttacgcgtttatgtatttactatattattatcattagataactccttcctcttatataaaaaaagtcggctgggcgtggtggctcacacctgtaatcccagcactttgggagggcgaggtgggcggatcacgaggtcagtgttagaccatcctgcctaacacggtgaaaccccatctctactaaaaatacaaaaaaattagctgggtgtggtggcgggcgcctgtaatcccagctactcgggaggctgaggcaggagaatggcgtgaatccgggaggtggagtttgtagtgagcggagatcacaccactgcactccagcctgggcaacagagcaagactctgtctccaaaaaaaataaaaacaaaaacaaaaattagctgggcgtagtggtgggtgcctataatcccagctgctcaggaggctaagacaggaaaatcacaggagaattgaacctgggaggcggaggttgcagtgagccgagatggtgccactgcactccagcctgggcaacataagcaaaactctgtctaaaaaaaaaaaaaaaatgaaacagcttcaggcaggtccttcaaggaattccagaaggcattgttatcaatcatctgagataacaacagttctgtgagtgttactgcccccaaagaccttctagcaggataacatggggaagtggaagacagtgatattgatgatactgaccctaggcctaggctaatgtgtgtttgtagcttagtttttaacaaaaaagtctaaaaggtgaaaacaaaataaaaaactaaaaacagaaaaaaacttagagaataaggatataaataaaatatttctgtatagctgtacaatgtgttttaagctaagcattattacaaatgagtcaaaaagttttttaaaattttaaagttcataaagtaaaaaagttacagtaagctaacgttaatttattattggaggccaggcatggtggctcacgcctctaatcccagcactttgggaggccaaggtgggtggagatcacctgagatcaggagtttgagaccagcctggccaacatggtgaaaacccatccatctctactaaaaatacaaaaattaggccaggcacggtggctcacgcctgtaatcctagcactttgggaggccgaggcgggtggattgcctgagctcaggagttcaagaccagcccgggcaacacagtgaaaccccatctctactaaaatacaaaaaattagctgggcatggcagcgtgcacctgtaatcccagctactcgggaggctgaggaaggagaattgctagaacccgggaggcagaggttgcagcgagccgatattgcaccactgtactccagcctgggcaacagagtgagactctgtctttaaagaaaaaaaaaatcagccaggcatggtggtgggcgcctgtaatcccagctactcaggaggctgaggcaggagaatcacttgaactggggaagcagaggttgcagtaaaccaagatcatgccactgcactccagcctgggcaacagagcaagactctatctcaaaaaaaaaaaaaaaatttattactggagaaagaaaaaaaaatttaaataaatttagtatagcctaagtgtacagtatttataaagtttacaatagtgtaatgtcctagaccttgacattcactcaccactcactgactcacccagagcaacttcctgtcctgtgaacttcattcatgtgcccttttatactgtatttgtactgtactttttctatgtttatatacatacttaccattctattacaattgtctatagtattcagtagagtaacatgctgtacaggtttgtagcctaggagcaataggctacaccatatagcctaggtgtgtagttggctataccatctaggtttgcttaagtacaccctatgatgtttgcacaatgatgaaatcacctaacgatgcaattctcagactatatccctgtcattaagcaatgcgtgactactgttttcctatacatacacatctatgagaattcttaattcattaaatttttaaaaatttttatttttgagacagggtcttactctgtcacccaggctgaaatgcagtggtatgatcacggttcactgcacccttgacctcccagggtcaagcaatccttcaccttggcctcccaagtagtggggactacaggcacgcaccatcatgcccagcaaatttttttttattttttgtagagacgaggtctcaccatgttgcccaggctgatcttgaacttctggggtcaagcaattctctcgcctcagcttcccaaagcactgggattaaaggcatgagccactgtgcctagccgaaaaagtttaatttataaattaggcatgggaagagattaacaacaataactaataataaagcagaacaagtataacaatatatgttatagaagttatgtgaatttgtctttttggtaagagacaggaaaaaaagaaattatgtaaatttagtgcctcaaaatatctttgtttttttagagagggggtcttactatattgcccaggctggtctcaaactcctggcctcaaacaatcctcacttccaaaaaactgggactacaggcgtgagccactgcacccagcctcaaaatatcgtatctgactgtactcacctattttcagactgcagttgaccatggataactgaaaccatggaaatcaaaactgtggataacgggggactactgtagctataataataatagtaattaggtgctcaacaattcctcaagattgctagtgtctaagggcctggcgggtaagatgtatttattcaacaggtattaatctattacctaccacatgtaaagcactgtggggaacataagatgagtaaggcatggattctgcattcaatttgtagagctgtaactgttgatgagagctaactgcaagaaagatgctgaaggtcccaaattctgtagaaggatcaagctacttcctgggcaaggcgacatttaagttaggctttgaagggtgaaaagaatttggacataggaagacaggaaaaaagacattctaggcaaagaagatgccatgtgcaatggccaggagataagaaatccagggctacatacacagaatgcagcacgcttcagttggcttttgcaagaaggcatcaagtgctgtagtgggcatgaagtgggcagtgtaagtccatagtgactctgaattcagaactgattctgcaggcactcaggccaggcgtggtggctcacacctgtgatcccaacactttgggaggccaaggcgggcagatcacctgaggtccggagtttgagaccagcctggccaacatggtgaaaccccgtttctactaaaaatacaaaaattagctggatgtgatggtgtgcgcctgtagtccacaccatcacatgcccagctactcaggaggctgaggcatgagaatcacttgaacctgggaggcagaggttgcagtgagcctagattgtgccactgcactccagcctgggagatggagcaagactctgtctcaaaaaaaagtttttaaacaaatcacacatcagcaagaaaaatgaggggaaaagctcccttactctgccatttttacctaggaacatggccatgagcttcttatcctgaagcaggatggctcctttcaccaagtactcaaagtaggagtccacgccagccccgatgcctgcgtcctgggccacccacttgccagtgagcacatcaatgtggttgccgacctgagagagagaaagacacacggtcccaacgggaaggccgatggccaaagaaggatctactcacccccaaccctgactgcccagggagatgcagggcaggtgccccagtgcttcttgggaaacatgcagaccctgagagggaagggcaatgctggatcatggccagccttcctgtacatctgcatagtagagatgcatctcatgcacatttatgaggacttaattatacacattgagcaaaaaatgaaaaagaaaaatgatttggagtgtttatgtcctgcctagagtgagtgtgagatgggagatgagaatttgctgttgccgcaatctgtctgatttctcagcacccagcatgtgattccactatctgaagacacagacgtgctttacgtatttccataaattaactcaataagaacatccaccaagaagctgacagagtggttctaaggagagaaaccgaatagctggagacaggggcaaaaggggacttcaccaatgtcactgagtacccttttttgtatcctttgacttttttttttttaattgttcagtctctgtagagactgtgaaaaattggcaatgccggccaggcgcggtggctcatgcctataatcccagcacgttgggaggctgaggggggcaaaatcactggaggtcagaagtccgagaccaacttggccaacatggtaaaaccctgtctctaataaaaacacaaaaattagccaggcatggtggtgtgtgcctataatcccagctactcaggaggcagaggcatgagaatcacttgaacccaagagggggaggttgcagtgagccgagatcgtgccactgcactccagcctgggcgacagggggagactctgtctcaaaaaaataaacaaagatacgtatttttctattttattgtatttattttattttttgtatttttagtagagacatggtttctccctgttggtcaggctggtctcgaactcccgacctcaggtgatacgcctgccttggcctcccaaagtgctgggattacaggcgtgagccactgcgcccagccaaatatatgtatttttcatatggcttagaccctcatggaagctggtaacttcatctggtactcaaagaaatagctaactgttccgcgttggtttgtgtccccccaggagcacaacctcattctgcctgaaagtagttgatttggaaggtaagtccttgtaaacaccagtagaggagggggaagtgaggcagggcaagggaggcggcatttaaggggtatgccatcaggcaggtttccaccatgggaactggagttcaatcttgctggggagcttaggaattcagtgtagagctccagcttcggagtgatcccacccaaggggcagggaactggaatgtttatccaccaactcccatcagtatcagttaccggcttgagagctactcatgggtagcattaaatcctggtaccctcagccaaaggcaagcagagtggctccaggcaccagaggagacccacaggcaaagaggcgcaggtgatggcagttggaagactggccagtgtgcatggaaatgttaagagttgagaggatatgggcatggcaccaacagagtctactacggtcccactgctggagcaaaacctgcctgagatggactaagggatttactacaggtctccagcggggcaccttttttttttttttgagatggagtttcgctcttgttgcccaggctggaatgcaatggcgcgatctcggctcatcccaacctccacctcccaggttcaggcaattctcctgcctcagcctcccaagtagctgggattacaggcatgcaccaccacgcccggctaattttgtattttttagtagagatggggtttctccatgttggtcaggctggtctcgaactcccaatctcaggtgatccgcccgcctcagtctcccaaagtgctggaattacaggcgtgagccaccgcacccagccttaggggggcaccttcttaagggattttcggggagtcctcacacaagctttacttttcaagctggattagcaccagactgcataaaatgtgcctagacctaaatgcagtcttcctaagtcagagtgactcagcaaagttggtattaatatattaacgttactgctgaagtaactgaggaccagagaggttgagtgacttgctcagggtcacacagtttcgatgtagcaaggccagggcttgaatccagttctgactaaatccagtgttatgtcctggatggctttggctcaattactgttaatcttattgattatcccatttagaagctgaaactgaccttagagatcatctggtccaaagtgtgttcaatttccatgggttaatagtactggaagataaagggaagctctggtgttaaataagtttgggaaatgttaaattaaacaaagttgaatagatttctttactagaggatttttattctgctcatgtgcattctgactctccaaaaaagggggggatattatatctaatattcccctaacttaattggccaagactcattttttcatgcaactgccactcagtatctctcagaaccggtgtcctaagaaacacagcaaatacagatagacgctaaaaatgaaggccggacgagctgatgatctgaagccgtcaagtgagtcaggggcatgaaacatacgaccctcttcctagaaatcagagaatctcaactggtcaaagctgaatgcagcccctgctgcctgccagaaacgtgctttcccactctcctccccactccaagccaaacttgaattggaggcttggtctatttttggtgtcctgagcccaaatcctggaccactcccaaggtcaccctaagttttccttggcttgactgcaacttattgctcagagccctgggcctcgtaagcagggactcaaacaggaagggcagcagcgaacctaccagcccgatatctgaccggctctcccagaggcgcatcaaagccactctggccacatcttcgaacaccgggtcaccagtgaggctgctcagggtggcaaattcaacaatgaaggtcccaatccctgccgtacaggtgacaggggtctctcctgggttcacgccatgaagtaagttcactgttccatatggcatgccagtgggggtctgaaaggctgaacaatcgacaaattatgatcccggacaggagcagggggatagggatagttctgatacacgcccaaagcctgggaccttagccagcacttccctctttctcctgggtatcctgctagagtctgagccagagaaagataaatgtcataactggagggccctgagcagccacccagcccagatgctgtcaaacactgctctgcataaccttgggttcctgctcatcatgagggggcagggagcaggctgtgctccacacacactcgctttagctagagagctttacctatttttatttattttacactacgccttcaaagcccaggcaggtaacttattgtgatgcaggcagggtttaagccacagaaagtggtggggcttgtggcacaatgacaagagtaagccccgttcaaagccattcatagacttttggctcacgcctataatcccagcactctgggtggccaaggcaggcagatcacttgaggccaggagttcgagaccagcctggccaacatggtgaaaccctatttctactaaaaatacaaaaattaggcaagcgtggtggtgcacgcctgtaattctggctatctgggagactgaggcacgagaatcgtttgaacccaagaggcgtgggctgcagtgagctgagattgcaccactgcactccagcctgggtgacagagcgagaccctgtctcaaaataataataataataaacaaagccattcatagactttaaataaagatctctgctttaaataaagagtataggggctaaattatttttaaagggaagcaaaataggatataaaccactaaaccacggatatagtatgaccctcgatttataggtagggaaaaccatgcctgtaaagaagtaattcagccacaggtcacacagagagagtcaaacagagctgggatgggaacgcctcccctgtgcccaccccagccccagtccagttctctgcccgccccacccaagtggcacccaagtgccttctggttcaagacgagaactggacaaccagccagaggcagagatttcctctctgggcctaaaggtcaaacaactccagagcagcctatgcgtcaccaaactgtgaacaaaggtgtcgacacttccaagaaccacagggtctagcaactgtgtctgccacagacaagaaacttgcaatctggcaggcaccagcgggagagcaagtcacaaccaggaagggctctaagcaatatttcagaaaaagtcaggctgtaataaaaagaagaggagtgacaaaatcctgtttcttgacctttttttataaaatgaccaatgaccaaaaataattaaattataaaggaggagcagctaggcagagtttccagagtttcctccagggatgaatcacacaggacacaatgtctgcaaggagacgctcaagccatgagccatgagccatgagtgagacctgaacctagctcacccgctatcctcagctctcccccaaaggagaggcaagtgctatgtgagaaggataaagaggccgggtgtggtggctcacgcctgtaatcccaacactttgggagtccaaggcagatggatcacttgatcccgggagttcaagaccagcctgggcaacatggtgaaaccccatctctacaaaaaaaaatttagccatgcatggtggcatctgcctgtaatcccagctactcaggaggctgaggtgggagaatcaactgagcccagaagttcgagaggctgcagtgagccatgatcacgccactgcactccagcctgggcgacagagcaagaccctgtctgaaaaaaaaaaaaaaaaaaaaattaagaaagaaaagggataaataagtgagatggccaagaggtgatggaaagcacagtgtgacgtgtctgggtgtgaacagtcctcagagcctccaccacaccctgaagggaacacagtgtacagttgatgctactgagcctggtgttactgccccactagacaaaaacatggaggcttgacctgcagccctggacacagcttagccacaaaacaaatccctctcgttttaaaagtgttggacgttctctaagcagtttctccttcctgacctcattttagcctctccaaaacccgatgtggtagggaagtagaaattatgattctcatttgatagatggggaaaccaaactgtggagagaggccagacacagtggctcatgcctgtaatcccagcactttgggaggccgaggcagccagatcacttgaggtcaagagtttgagaccagcctgatcaacgtggcgaaacttcatctctactaaaaaatacaaaaattagctgggcatggtggcaggcgcctgtaatcccagctactcaagaggctgaagcaaaagaattgcttgaacccaggaggcggtggttacagtgacttgagattgtgccactgcactccagcctgggcgacagaacaagactccatcacaaacaaacaaacaacaaactatgaagagaaagagtggcttggtcacgatgttggctggcagagctgagtctagaatccagggctgctaatgctcacaccaacacccttccctgggcccctgttactccagcagtgtgtggaataactgtagtacctggaaggggacaaatgggctcattcaaaataagggtaatggccttccacccaccaggctggccaccttcaaccatcccctgcaaacaataatgaggtcaactcatccatccgggtcagggccccagcaggcccttaaaatgcccaggacactcctgatttccatggtgggtgcctggtgggtagaaagaccaaatacacctggtgagaaataccaggaattaattcagcactgccactctcatcttcagcaagggaagcaggacctactggacttcgtctctgccccatctctgtgtgggtcttacctgggaggagttttcgggccgcctcctcagccattctcaggagaggcccggaacagggccatccagcctctacttccaccccagccttcttggagagcagatgagcagacaggagtcctcctaccactacagatggcacagaaagcaaatggcacagtccaaagggaaagaccaagggatcaaggatctttcccctgtgcgagttaaacataaacactctattgtggggcgcatgttctcaggacctcctgaagctatttcacgggtaaaaacaaacaaacaaaaacctcactctgttggggtggctcactgggaaggagctagagccacccagcgaaaaaagagtcccttaatcccacatatttctatggtgttaagtttatggggttttcttctcttggttcatcacaggaacagtggctattttttgtaagtccctattgtgtaccaagcactaagtactactgtcccctcttcgtatgaagatactgaggttccatgagataaagtgacttgccccaggtcacccatctagtaggtggtagggctgagtatctttgattccaaagcccatgctcattccatttgtcactctgtctgtctcccagtcacctgtcatacctggggggaaggggtaatgatggttattacctttattttactaatttatctatttcaacttattatgcaatatgtagaactttttttttttttttttgagacggagtctcgctctgtcacctaggctggagtgcagtggcgcgatttcggctcactgcaagctccgcctcccaggttcacgccgttctcctgcctcagcctcccgagtagctgggactacaggagctcaccaccatgcccggctaatttttttggattttttttttgtagacacggtgtttcactgtgctagccaggatggtctcgatctcctgacctcatgatccacctgcctcagcctcccaaagtgctggatttacaggcatgagccaccgcacccggcctacttagaacttttaaaaagacacaaaggttcttggaaatacagctaaatagatatcctgagtggccctctcaatgaaaataactggtgaccctaagtttcaaaattcccctcctccctgcagagggggaataggagaccaaggtcagacctgccccaagtggaagtctgataaaaggtccctatgcaggccaggcatggtggctcacatctgtaatcccagcactttgggagccgaggtggagatcacgaggtcaggagatggagaccatcccggctaaaatggtgaaaccctgtctctactaaaaatacaaaatattagctgggcgtggtggcaagcgcctgcagtcccagctacttgggaagctgaggcagaagaatggcttaaacccaggaggtggaggttgcagtgagccaagattgcaccactgcacttcagcctgggtgacagagtgagactccgtctcaaaaaaaaaaaaaaaaagtctgggcacggtggctcatgcctgtaatcccagcactttgggaggctgaggcaggtggactgcctgagctcaggagttcgtgaccagcctggtaaacacggtgaaaccctgtctctattaaaaatacaaaaaattagccgggcatggcgttgtgcgcctgtagtcccagctactcgggaggctgaggcaggagaattgcttgaacccaggaggcggaggttgcagtgagctgagatcatgacactgcactccagcctgggcgacagagcgagactccatctcagaaaaaaaaaaaaaaagaaaagaaagaaagaaaagaaatctacatgtatgtaccttatggtaaaactgcagaacaccaaagggaaaaatgatctcgaatgcagccagaatccatgtaataataattattaatgctgggtgatgggcacgtctggttcattatgctattttctctacttttatgtttgaagttttccataacaaaaagtttttaaaaggagaagacagccaaagtgaaaaccaaaacaagattctctacaaataaataataattacattgacagattacttcttaacaataatgaaaccagaagataatggaaaaagtttttaacacaataagagaaagtaaccatcaacctagaaccatacacccagcaaaaatatcactcaaaggccaaccaaaggcagttgaataaagacattttcatataaacaaaagctgggaatgtttatgaagcacacacctgcattaaaggaaattctaaaggaaatactttagagaaaaggtctgagacacgaaaagaaaaaatagtcaaaaaagtggtaaataggccaggcacagtggctaaacctgtaattccagcactttgggaagccaaagcaggtggatcactcaagatcatgagtttgagaccagcctggccaatgtggtgaaacaccatctctactaaaaatacaaaaattagcctggtgtggtggtgcacaactgtaatcccagctactctggaggctgaggcaggagaatcgtttaaacccaggaggtggaggtgagccaagatcgcgccactgcactccagcctgggtggcagagtgagactctatttcaaaccaacaacaacaaaaaaagtggtaaatttatgtgtaaatgcaaaacttcaacaatatagaacaaaaattataatgtatggaaggtttaaaacaaataactaaaatatataactgtagcatataggtcaggatgttctctaagtcaggttttgcattattcaggaggagaacaaagattttcattaaatttagactttgataagttatgtttgttaaatttgcttggaaaactatgtaaaaagctagatattgtgcataatttccatattagtaagaggaaaatggaatggggggaaaacaatctaaagaaggcatgaaaaaggacagaataaaggaacataaagaagatggcacagggccaggtgcagtggctcacacctataatcccagcactttgggaggctgatggggggcggatcacctgaggtcaggagttcgagactagcctggccaacatggtgaaaccccatctctactaaaaatacaaaaattagcagggcacggtggcaggcacctgcaatcccagctacataggaggctgagacaggagaatcgcctgaacccgggaggcagaggttgcagtaagccaagattgcaccactacactcccgcctgggcgacagagtgagactccgcctcaaaaaaaaaaaaaaaaaaaaaaaaaagaagacggcacagagagcacaatactgtagaaatgagtgcaaatatatcagtaattacagtaaatgtaaatggattaaatgtgccagttaaagattgtcagaatggataaacaaaatataatacactatttgcaaaagatgtatctaatcataaaactacagaaagatggaaaggatagaaaaagatacatgggaaaatgtcaaccaaaagaaagctggtatcacttatattcctatcagaaataaaggtataagaatgaccttcatttacagatgacaaactgggctcagaagctgggagacatagcagcaagtacagcctcaaactcaggccggattcctaaaccaggattttagaccatgttgtccctctgctctcttctcttttttaatcttttatggatcatatgtctggaatataagtttcattgcagaaaacatacaaaataatggggaaaaatagaactctgccatccagaggtgacagctgttaagtggtctagaggttcgatgcaaataagggctgtgctggcttcacaagaatcactggaagtctgctaaaaatactgattctaggacccaacacagagattccaattcattaggtttagggtggagtctcaacatctgaattttttaaccacttgggagtggttcctatgggctgccaagtttggaagattaatgctgtagatttgcactgtccaatacaataatcactaactacatgtgactacttaaatttaatatcattaaaattaaatgaaattaaaaattcaattccatagttgtagtagatacatttcaaatgctcaatagctcatgtggttcgtggctaccatactggacaaaacacagctataagacatttccatcactgcagaaaattggattggacagacaataagttccaagaaggcaaggatcatatctttcttgttcatagctgtatgcctagtatcaaatacatattaaagaggtgagtaatctggtgtatttctttccagtctcttagtctcctgctcactttcatatctgaaactgatggggaaatcctgagacttccccacctcaccctccaggagggaagaagagctctgtcggtcagaggttttggccaagggtcctggcatggtcagtccttaaaatcctatttaccacttcttggtttacagaggcaacttcacactcttttttcttttaaaggtcctagagagcagcccttacctcgaatgtttgtttcaaacacagaggcgttcacatcaatatcaaagtccacgctgtcctggagcacttcaaccactctttggaattctgagacattccccaaaatctggaaataaaaaagagacctgacaatgaggctcttacatgcatggaggcagattcagagtctgggatcctatgttgatgtggccctcactaattccacttaagacctccagtttctgtcctaggattggtgacagcagaagaaaacactgagagctagaaatcatctagagacttcataccaagagactggttaagtaaattcctaggtcccaattaagagtcacgatgttgtcatttaaatggacacaatataaagaacgcaaactacgcatagaagtcttaggttttttgtttcgtttttttgagacagagtctcgctctgctgcccagggtagagtgcagtggcgtgatcttggctcacttcaaactccgcctcctgggttcaagcgattctcctgcctcagccccgagtagctgggattatgcaccaccatgcccggctaatttttgtatttttagtagagacggggtttcaccatgttgatcaggctggtctcaaactcctgacctcatgatccacccgccttggcctcccaaagtgctgggattacaggtgtgagcgaccgcacctggccaaaagtcttagtttgacatttgcagtagataccagttgtcaccttcaaccttgtggaaaacagaacaggttggttggcccaaaacaaattcattcctaccctctttacctcatggcctcccaccagaggttggaaatccagaagctttctcggcctcctttgctgctgcagttgattgtgttacccagtcaattctgacccttgagaggtctactgggggcacttctgggaaggcttctgttttcttaataccaagggacaaacacagctaacatggcttttagtctctctctttctgccttgaactcagactcgatttctgaagtgatggcagctatgtgagaccatgacgtactaagcattagaataaaagccaaaacactaacgatactagaatgcaaagctacaaagaggctggtctctaatgacacagttgcgtagctgacccaatgctagaaattacctctagactttcttttacttgagaaaataaaccctctttatttaaaccgttagccaaatgcaatctcaatctctcttcttttgatagtaacatctcaatttaccctcgaggaatcactcttccccggcagtcactcctgtggtttgggagaggctgatcccatccctctagctgtggagtgggtacttgacctgaaccagtccaagtcttttttttgagacagggtcttgctctgttacacaggttggagtgcagtggtgtgatcatagctcatcacagcctcgaactctgggacttgagcaatgttggcctcccaaagtgctgggattacaggcatgagccaccacacctggccctttttacctttctaagcatcaggtttcttttatatcttttttttgtttgtgtgagacagggttttactctgttacccagaccagagtgcagtggtgcgatctcggctcactgcaacctctgcctccctgactcaaacaatcctcctacctcaccctcctccctaacaaatggagccacagacatgtgccatcatgcctaattttttatatttttggtagagacggggtttcaccatattgcccaggctggtcttgaactcctgtgctcaagcagtcctgccgccttggcctcccaaagtgctgggattacaggcgtgagccactgtgcccatccctaagcatcaggtttcttaacgataagaaggagtaaaggtactaacctcaagaagttgttagaagaattaatacatgtctgtactaagccctacagaaacatactaactagtcactgatattatttctttataattttttttgagatgaagtttcactcttgtcacccaggctggagtgcaatggtgcaatctcggctcactgcaacctccgcctcccgggttcaggcaattctcctgcctcagcctctccagtagctgggataacagacatgtgccactatgctgggctaattttttgtattttaatagagatggagtttcaccatattggccaggctggtctcaaacccctgacctcaggtgatctgcctgcctcggccttccaaagtgctgggattacaggtgtgagccaccatgctcagcctgatacccttttattatcattgaacatggccactagaatgtaagcctctgaaaacaggagatgtcaaagtctctgtatcccccatagagctatgcaagcctatcacaattctccgtacataacaggtcctctataaatgtttgctaaataaatgaatctgcataagttgtagttcgtttttcccctatctagctaggcaaccacagccggacgcttcagaatcatgagatgcaaataaaaggcctaggagaggaattcatttttcacccacagtcacgctgccaaaagaggaaggatgttggttatgtaacagtggaaaggaaaagaaacagacgagatacttaccagcaaggtgtccagtgcatcaattagagtcagagaaaaactgcaaaaggacagaaatcccagccgcttagtaagaaaatcaaataccagatattatggctgccctagatctgatccccctaaaactaaatgaggcaaagtaatgcctctgcctgtcccacttacagtcacaacagagaaaccacagtgaaaatcgcaggtattctctgacccacttaatgcacctgggagggttggctgatgtagctcaattgtaattaaatacatcacctatagtctggcattctcctctaccattgggaggcagtataagattgcagcttaaagcacaggcctttcaccaattttcacctctaggaatttaattcacagtgaacagctgtttgagagtgttcatggcagtattgcttagaacagcaagaggctggaaagaacccaactgtccacccattaatgggtgattaaactgtgttataaacagtgcaaaactatgagttatcaaaaagattgttatcaagacttctatgtgctgatggaaagacattcgaattgtttttaatgaaaaagtcagggtggtttagtatgtttccatctgtttcaaaaagacatgctgacagaaagcagacagcaattgttagggtcagtggtggtgcagggatgaactataaagggccacaagggaactttttaaagtgacagaagtgtttcatatcttgactgtgatggtggtcacttcaaacgagtgtaggctgggcacagtggctcatgcctgtaatccgccagcactttgggaggcctaggtgggtggatcacctgaggtcaggagttcaagaccagcctggccaaatgacaaaaccccgtctccacaaaaaaattagccgggtgtggtggtgggctcctgtaatcccaactacttgggaggctgaggcaggagaatcgcttgaagccaggaggcggagtttgaagtgagccaagatcacgccattgcactccagcctgggtaacaagagcgaaactccatctcaaaaaaaaaaaaaaaaaaaaaagagtgtattttattatatgtaaattatgcctttaagaagttcattttaaaaagatacacatacacacatctatatatataatggtataaaccaagaatatttctggacagatacaaaggaaagttaatagttggaattctagggtatgggagatatttattgtatataatcttttaccacttgaatttgccatttgtatttactttgtttcaacttaaaaaaataaaaaccatcacaagttttgagtttaatttctcccgaccttagcacattcgtgtgtaaaacagggataatggcacctaactcgtaggggtattaagatactgagctgagatctgaatgacaagcagcagccagtgatgggaggaaaatggggagtgtatttcaggcacggggcacaccaactacaaagacttaagttttaggagtgtcacactccttcctggatctgaatgcccacctacataatgaaaggggtgggttttctaattcttggagcccttccacggtatctcgttactccagaaattgcctatgtccccacagctgatgcctgttactgctggggctgagctcagcgatccagcccacccggctaatccaggactttttttttcactgcgagaggctaagtggatcctggaggtgatagtaagaattgcggggagcgcggctctagctcagctgggagctttctggtgccggtgaggagaccatgaagccaccagccccagctgacccgcccgccgaggcccagagagtcagaccctggccgccccttgcccctccgctcgcactacctgccccaggtgtcgtgcccgtcacaggtgagaggtcgcagctcatcgaagggaaaggcattctccaggtagctgtcgtaggcgtggtagaacatggccttgactcgctccctgggtgggggacgagaaatcaggcatggggcaagaacacaaaaacaagcgggggaagaacaagatacagggcggaaagtgggaatcactagctgatttctccctgggacctagcggctgtgtcggagcaagtcggggtctgggatggacggaaagggaaaggaccgggttcacgcttcccattccccaactgcgaaagggcgggtcacagttcacctgtagtgggcgggatctggcgcggagccgtcgggacctggcgcaccatggtgctgaggcagcagcgcgcacaggaggccgagcgggatgagcagccggaaaggcatagagctcgtgtcctctcagcgcccccgcagcagcagcagccactgcaaccagttcatcctgggagctgctgcgggttcttccgggaatccgcgccactgcgcctgcgcgctgagaaatcagcctctcacttccggactacaagcccctgaatgcaatgggcagcgaaacgcggccgaagagcaacttcggatgtacggtttcggcaacactgatcaacgtgtcttaaagtcagtggctgttgttactactgttattaattaatgttttaataataacagctagcatgtattgagcacttattgtgtactagtactgtacggagcatttaaaatgcattctctcattcatttttttcaacaaccttattaagtatgaaggcagggtaagcatgagaaatgttcagcctttaccattattacctagcaggacaagccgcagacaaaactcctcagacaccgggttaaagaaggaaggagctttattcggccgggagcgtcagctgactcacttctcaaaaacggagctccccgagtgagcaattcctgtcccttttaagagcttacaactctaagggggtccgcgtgagagggtcgtgattgattgagcaagcagggggtacgtgactgattaccggtgcaccggtaatcagaacggaacagaacaggacagggattttcacaatgcttttccatacaatgtctggaatctatagataatataaccggttaggtcaggaggggtcgatctttaattaccaggcctggaatgcatcgccgggctgtctgactactgatttcacttctgtctttcttttaactcctacattttctttgaggcagaaattgggcataagacaatatgaggggtggtctgctcccttatttagggatattgagtttcccaaaccagttacttgttgattgtataagacacaactcacatttatttgtccaaaacttccactcttttttttttaaaacctcttgcattttccgatgctgtcactcttgaggtttcctgaaatcccgtcagttctaggaattcatgacacttctctcctcccaatttgggatgtggttacacaatcatggtcccttcagtctccatctcaaaccggaagctttacccctgtcagccctgtagaatgtcttgggtaagaatgaataccctggttgggcgcggtggctcacgcctgtaatcccaacactttgggaggttgaggtgcgtggatcacctgaggttaagagatagagaccaacctggccaacatggtgaaaccccgtctttactaaaaatacaaaaattagccaggggtggtggcgggtgcctgtaaatcccggctactcggaaggctgaggccggagaatcgcttgaaaccggaaggcggaggttgcagtgagcgaggatcgcgccactccactccagcctgggcaaaacagcaaaactccatatcaaaaaaaaaaaaaaaaaaaaaaaaaaaaagacaaatgactaccctggggcactatagctttcaggaggtttgtgatccatttctccattccccttattcccaagtttctaaaatttggtcagcaccttagaccacagcaacacccatgactttggtcagtgtgacatgcggtagaaccaacactggatttgaagtcagatctaggatccagttaattacaactctgtcactcatctataacctgtgtatgtgaccctctccttctctggggctagcatccttgtctataaataatgaggagtttgaacaaatggatctttaagatccttttcggtcgagctttctatgattctaggattggctatctcttatttgctgaaaaagtcagatggaagtgatagctcagtttgttgagccagagtgcagccaggcctcccaaagtgctgggattacaggcataagccactgtacccagcctgggatgtttttagaaactcttcttggccgggtgcagtggctcacgcctgtaatcccagcactttgggaggccaaggcgggcggatcacgaggtcaggagttcaagaccaacctggccaatatggtgaaaccctgtctctactaaaaatacaaaaattggccgggagtggtggcagacgcctgtagtcccagctactcaggaggctgaggcaggagaatcgcttgaacccgggaggtggaggttgtagtgagccaagatcaagatcaggccactgcactccagcctgggagacagagcgatactctgtctcaaaaaaaaaaaaaaaaaagaaactcttcttggggcttccaaatggaagggaaaggagatgacagtaagctgagacctggataacaacacaggagcactgtattcgtttcctgtgattcctgcaacaaattaccacaaaccaagtggcttaaagcaacagaaatttattctctcgcagtttgggaggtcaggagcctgaaatcaatttcactgggctaaaattaagttattgacagggccacacccactccaaaggctctaagggataatccgttccttgcctctctagattctcctgactgctggcattccttggcttatggttgtatcactccagtatctgcccgtgccttcatatcgccttctctgtggatgtgtcacatctccttctgcttttctcttataaggacatttataattgcatttaggaccccccccgcgccccccccaacccagataatacaggataaactcccattccaagatttttaacttaatcacatctagggggaaaaaaaaaaaaaaacaccatttttccaaatagagaaacatttacagtttccagagattaggacctggactttaggtggctgtttccagcctagcgcagggactaaatatttttcagacctgggcctttccctgtgacgaaattcaccttctccatattataaatcctatagcttatctttttgtctcccattcaaaattctagtgtggataaaacttttgcaggaagggtgggttcaggttgcctggatttggtaacgataggtctctctttatgagcaagattgaaacactcatgattttcctttatattctttttctagcttgatgtcattctccacactgtcactgaacaaataaaaccatgacttacgttttcacaattcatgtgactatatgttctctaatgagaataaaaaaattgttttaccctctggaaagtatcaggactcttctttctctcactctgtgtttatgatattggattctagaaggttatgacccaccagtgaagtgtcacacttgagcatttacttgtgaagagactcagggtaagttgcctacctctctgagactcaatttcctattgtaaaatacagaaattgatgaggccataaaggaattctgggaattaaatgggataatgaaagtgaacattctcagcacagtgactggtatatattaaattcttgatacatattaattctcttccctgcctccccaactcttcttttttttttaaggcagggcagttgtttccatttactgagcatctgccccgagtcatccaaggtgttataggcaatagttcctaccctcaaaagtttgaggcacagtgctgagcatataactaagattccaaaataatcaagtcatagtcctttcccttgaagtgcttgcaattttgttagaaggggaagatgtcaattggagaatacttggaatcatagggtgttcaagtcttccctgtgggtgaatagagtttggagggagctcagatcacatcagtatctgaggccaatgtcctcggactctgtgttcagtggaacaagacttggactggttgtcggaaacccttggtcttgttacttgtttatccactatctctgtgtgatctcgggcaagtcattttcccttttggggactcagtttccatatctggaagatgaaagagtgagactatctctcagcacaaggaaaatattaacagatccatacagttattgcaaaaaatcagaaaacagaattcaacacacatcgactgcacaaatttcccccagaaacatccatgaagcagaataaaacagtgggacagcattccaaatggaatttgactatttgccaactaaacaaggaagaggagggggatggggagggggacaagaagaagaaggagaaaatagtcacgtgtattgataatagcgaacatttacatagcaagtaatgttctttgtactttacatccatcaacaccattaatccttaccacaaccctctgagaaagtgtcattatcaccattttataaaccaaaaacctgaagcacagattctaagaattgaagaaagatttagcaacttaatcaatgtctcataccgaataagtagaagagtcaagatatggacccaaacagcctatactctaacgcattaatgaaaataatgacaaatatataaataaaaggccaacacagaattcaacaatggagatctggcgaactgctacagtgtcctctagctttagcttcatgtggttttagggtcaacatttccttcccttttgctagaaagttagagggaaaagctcagttccctgaagttggaagccaaggcattttagatcccctttggccaagtacactcgacctcttttagcagggaagaatcctttttgtagcatctggaggtcatttggttctcccaactcccaaagcagggcttgcacaatacatacttttgacttgccaaaaaataagtttatccctgggaaatttcccatccatctgttgctttgtagaaatgcttgaactttgcatgcagtatgtccaaacatttcgatcgactccctggttagagtctcagacctcgttattattattattattatttgagatgagagttttactctcgtcacccaggccatagtgcagtggcgcgatcttggctcaccacaacctccacttcctgggttcaagtgattctcctgcctcagcctcccgagtagctgggattacaggcatgcgccactatgcccggctaatttttatatttgtggtagagacagggtttcgccatgttggctaggctggtctcgaactcctgacctcaggtgatccgcccacctcagcctcccaaggtgttgggattacaggcattagccaccgtgcctgaccttacacttttattcttattttatttttcttctttttgagatagggtctcgctctgtcacctaggcactatcaccactcacttcagcctcgacttcccaggctcaagtgatctttccacctcagcctcccaagcagctgggaccacagatgcgtgacactatgcccagctaatttttaatttttttgtagagacaaagtctcgctgtattgccgaggccggtcttgaactcctgggctcaagcaatcctaccgccttggtctcccaaagtgtagagattacagaaatgagccaccacacctggcctcagaccacgtttttattatgctcatattccaagtgaactcagacctgtagctaaatctgccacagaattgtgcactttaaaatggttcagatggtaagttgtgtcacaagtattttgtcacaatttcttaaaaattaaaaagtgagccctctccctctccctctccctctccctctccctctccctctccgtctccccacggtctccctctcatgcggagccgaagctggactgtactgctgccatctcggctcactgcaacctccctgcctgattctcctgcctcagtctgccgaatgcctgcgattgcaggcacgtgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacacctcccagccgcctgccttggcctccctaagtgccgagattgcagcctctgcccggccgccaccccatctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagagtctctgcccggccgcccatcgtctgagatgtggggagcgcctctgccccgccgccccatctgggatgtgagagcgcctctgcccggccgagaccccgtctgggaggtgaggagcgtctctgcccggccgccccatctgagaagtgaggagaccctctgcctggcaaccgccccgtctgagaagtgaggagcccctccgcccggcagctgcccctactgggaagtgaggagcccctcagcccggccagccaccccgtccgggagggagatgggggggtcagcccccccacccggccagccgccccgtccgggagggaggtgggggggtcagccccccacatggccagccgccccgtccgggagggaggtgggggggtcagccctccgcccggccagccgccccgtctgggaggtgaggggcgcctctgcccggccgcccctactgggaagtgaggagcccctctgcccggccagccgccccatccgggagggaggtgggggggtcggccccccgcccggccagccgccccgtccgggagggaggtgggggtgtcagctccccgcccggccagccgccccgtccgggagggaggtgggggggtcagccccccgcccggccagccgccccgtccgggagggaggtggggggggtcagcccccctgcccagccagccgccccgtccgggaggtgaggggcgcctctgcccggccgcccctactgggaagtgaggagcccctctgcccggccagccgccccgtccgggagggaggtgggggggtcggccccccgcccggccagccgccccgtctggtgggggtgtcagccccccgcccggccagccgccccgtccgggagggaggtgggggggtcagccccccgcccggccagccgccccgtcagggagggaggtgggggggtcagccccccgcccggccagccgccccgtccgggagtgaggtggggggggtcagcccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcagctttgtgggatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaattaaaaaaaaaaaaaaattaaaaagtgaggctgggcacagtgcctcaagcctgtaattccagcactttgggaggctgaggcgggtggattgcttgagcccaggaatttgagaccagcttgggcaacatggcaaaaccctgtcactacaaaaaaaaaaaaattagcagggtgttgtggcatgtgtccataatcccagctactcaggaggctgaggtgggagggtggaataaatggaatgtgatccaacaaaattattattattattattttgatgatgtctattgcccttttgaaatacccaattctggcagggtgcagtggttcacgcctataatcccagcactttgggaggccgaggtgggcagatcacctgaggtcaggagtttgagagcagcctggccaacaaaccccatctctactaaaaatacaaaaattagccagctgtgttggtgagcgcctgtaatcccagctacttgggaggctgaggcatgagaattgcttgaacctgggaggtggaggttgcagtgagccgagatcatgccactgcactccagccagggtgacagagcgagactctgtctcaaaagaaaaaaaaaaaaaaaaaagaaatacccaattctttcacagaaaatatgttcttactggctggcggggagaggggtggttggtaaatgggaaaagggtgcttcctttgctgatatccaaagcagatactttctctgcctatttgatgatacaaaactagccctaccacaccaggctaagggagagaagaggatccgtgtcctacagaattccccctattagcctacctgccccatagcccccaaactctgctgctaatcaactgtgccaggtcaggaagaaagaaactggagggaaagaagaagcctaatagattgaaaatcccttcagcaaacattttttgagagccttataactgttagtgtctactgaattaaacttactagtgttaagaaaaattatctgaaacatgttactaaggtaaaaagatgattgtgtgactttttgctgtcatgataaagcattgactagcaagtctacttgtcatctgtccctgaagagaaacgtgacactattttcatattaattacggcccagacattgtacaattctgtaaagtaataagatgtgacaatttcctttcctgcctggtagagaagataatcccaaaggttatgatattattactctgtaggacattaacccatttagtatttaatttagcaatcttacttcaatattttccttttccattgactataaaaactcaagttcttttttcttttttttgagacaggtctcacattgttgcccaggctggagtgcagtggttcgaacacggctcactacagtcttgacctcccacatcccaggctcaagtgatcttgcctcagtccctcaagtagctgggactataggcatgtgccaccatggccagctaatttttgtatcttttcgtatagacggggttttgccatgttgcgcaggctggtctcaaactcctggctaagcgatccacccaccttggcctcccaaagtgctgggattacagatgtaatcccaccatgcccagccaaaactctagttcttatattctattttgaactggctttgtcgtcctgcttgtcccttcattaatgagttaaatgaaactctgacccatgctcactgtctatttcaatgagaattatggttggttttgtttgtttgtttgtttgttttgagacagagtctcgctccgttgcccaggctggagtgcagtggtgtgatcttggctcactgcaatccccgcctcccagattcaaatgattcttttgcctcagcctcccaagtagctgggattacaggcacctgccaccactcccagctaatttttgtatttttagtagagacggggtttcatcacgttggctagactggtcttgaactcctgacttcaagtgatccatccactttggcctcccaaagtgccgggatttacaggagtgagccactgcgcctggccaagaattacatttttaacatgctgacagttgtccttgacactaagtgtcagaccctggattaagtaatttatagacccatgatactcctttgagatagtttttgtccccattttccagatgagaaagtgaaggcacaaaaagataaaagaaattttctcagtgccagttttgtgccaggagctttactaagttacagtttttttctccttccctcgaagtcctgtttatctattcattgattaaaaaaaaaaaaatcattgagtacttacgatgtgccaaatactctgctaagctggtaatacagaactttaaaacacattctctgccctcttatggcttttggtgtggaagacagatgcataaatagacaattatcatttaaagaagtaagggaggaaaactctctgaacttattctggtttgggggctgcctgcaaaaaaattaattaatgaattaattaattaaaaattaaaaaaaataaaaagaactaagggaaagagagggctccagtagaacagagggagcatctaaccctggcttgtggacatgaagtcagggaaggcttcctgtagtaggtgacacctgagtattctaataggaattagtagggctgaagaaggtggtgggaagcacctcaattcaaaattttgattcctttgtgtattatgaaaggctcttctgactcctgcttacctcctcatatcacttcttccttcctatcacctactcctatttggccatacttaagtattactgctttctcaagtatgttatattctctctcctttcctattatattcttttgtaccttcttcaccctgtacttgaaacaactttttcctcacccctacttgccccttaggcattatcggggttttttgtttttgtttttttctttgtttgtttgtttttgagacagggtcttgctctgtcacccaggctggagtgcagtggtgcgatctcagctcactgcagcctcagcctcctgggctcaagtgatcctcccacctcagcctcccgagttgctaggactacaggcacacgtcaccacgcctggctaatttttgtattttttgcagagcccagatgaactcctgggctcaagcaatcctcccacctcagcctcccaaagtgctgggattacaggtatgagccaccggacccggcctggaaagcattcctttttaaaccaggaaaatggcaagaatattctcttatattctctatcactttttttttttttttttcctggagacagagtcttgctctgttgcccaggctggagtgcagtggcacgatctcggctcactgcagcctccgcctcctgggttcaaacgattctcctgcctcagcctcctgagtagctgggattacaggcatgcaccaccacacccagctaatttttgtatttttagtagagatggggtttcaccatattggccaggctggtttcaaactcctggcctcgagtgatccacccacctcggcctcccaaaatgctgggattacaggcgtgagccactgtgcctggccttctattactatctctgttaaacattgtactagaggttatagccagaacaataagttgaaacaaacattataaaaattaaaaaagaagaaataatctgtcattatctattggtgctatgaatatgcatgtagaaaatccaaaagagtctaaaaataattattataacaaacaaaagaatttattaaggttgctagaaacaaaactaatgcaacaaaatcatcagtacttctatatgctgagaataagcacaccatgagatttaaaaaaaaattatttgcaataatatttttaaaatatggagaacttgactgggtgcagtggctcatgcctgtaatcccagcactttgggaggccaaggcgggcagatcacttgaggtcagagtttgagaccagcctggccaacatggtgaaaccctgtctctactaaaaatacaattagactggtatggtggtgtgtgcctgtaaccccagctactctggaggctgaggcaggaaaattgcttgaatctgggaggtggaggttgcagtgagccaagattgtgccattgcactccagcctgggcaacagagcaagactctgtctcaaaaaatatatatacgtatgtatatatgaagaacttagaggggaaaacttaacagaggatgggccatatgttcagagagaaaattatgaaactctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagctaagacactcttgaagaacaaagaggaaaggcttgatctacaagatataaatacattatgaaataatactaatcgagggccaggcactgtggctcacgcctgtaatcccagcactttggaaggccaaggcaggtggatcacctgaggtcaggagttcgcgagcagcctgaccaatatggagaaaccccgtctctactaaaaacacaaaattagccgggtgtcatggcgtgtgcctgtaatcccagctactcgggaggctgaggcaggagaatctcttgaacccgggaggcagaggttgcggtgagctaagatcctgccattgcactccagcctgggcaacaagagtgaaacaccgtctcaaaaaaaaaaaaaaaaaaagagaaaaaaaaatttaaaaaaaaaagaaataatactaattgagataatgagcattggtaccaggtgagacaactggaccactgaaacagaatagacatatttactgtaagtcagagatgccactgcagatcagtaaggaaaggccaacttttgataactggttctgtctgggacagtggatatccattaaaagaaactaatcttgacctccacttcataccatacctcaaggtgaaagacaaaactaaaaagctttgaacataaacagaatatcttcatgaccttggggtttagggaagggttgcttaaataaggcacaaaaagtacaaactgtaaaggaataggttgataaacataaccaccttaaaattaggaacttttgtttatctaaagacatgataaagaaagtgcaaagcggctgggcgcggtggctcatgcctgcaatcccagcactttgggaggctaaggtgggaggatcacttgagcccagaagtttgagaccagcctgggcagcatagcaagacctcatctctacaaaaataaggttttttaaaaaaaaaaaaactgtgacggttaaaccacctactcaagactcagcaatggtggatgccctacgacacctaggtggcgtagcctactatacccctaggctccttggtatagcctattgctcctaggctacaaacctgtagaacatgttatgatcctgaatactttaggcaactgtaacacaacggaaatatttgtgcatcttaagaaatctaggatttgctggcaagatggccaaataggaagagctctggtctgcagctcccagtgagatcgatgcagaaggtgggtgatttctgcatttccaactgaggtacccggtttatctaattgggactggatgggcaatgggtgcagcccacggagggcaagccgaagcagggtggggcgtcgcatcacccaggaagtgcaagaggttaggggatatcccccctagccaagggaagcggtgagggactgtgccctgggaaatggtgcactacggcccagatactgcgcttttcccaaggtcttcgccacctgtagaccaggagattccctctggtgcctacgccaccagggccctgggtttcaagcacaaaactgggcggccatttgggcagacaccgagctagctgcaggagttttcttttttttttttcataccccagtggtgcgtggaacgccagcaagatagaatcgttcactctgcaggctgggcgcggtggctcatgcctgtaatcccagcactttaggaggccaaggtgggcagatcacgaggtcagaagttcgagaccaccctggccaacatggtgaaaccccgtctctactcaaaatacaaaaattagctgggtatagcagtgggggcctgtaatcccagctactcaggaggctggggcaggagaatcacttgaacccaggaggtggagcttgcagtgagctgagattgcaccactgcactccagcctggacgacagggcgagactccgtctcaaaaaaaaaacaaaaaaaaaaaaacaggtttgttcaatccgctggaaagggggctgaagccagggagccaagtggtctggctccatgggtcccacccccacagagctcagcaagctaagatccactggcttgaaattctcgctgccagcacagcagtctgaggtcgacctgggatgcttgagcttggtggtgggaggggttgtccgccattgctgaggcttgagtaggtggttttaccctcacagtgtaaacaaagctgcagggaagttcaaactgggtggagcccaccacagctcagcaaggctgctgtggccagactgcctctctagattcctcttctctgggcagggcatctctgaaaaaaaggcagcagccccagtcagggacttacagataaaacccctggccagcacggtggctcacgcctgtaatcccagcactttgggaggccgagacgagtggatcatttgaggtcaggagtttgagactagcctgactaacatggtgaaacaccatctctactaaaatacaaaaaaaatgagccaggcgtggtggcaggggcctgtaatcccagctactcgggaggctgaggcaggagaattgcttgtacccaggaggtggaggttgcagtgagccgagattgtgccactgcactctagcctgggtgatagagtgagactctatctcaaaaaaaaaaaaaaatctccctgggacagagcacctgggggaaggggtggcttggaaacagcttcagcagacttaaacgtccctgcctgatggctccgaagagaactcccaggacaacattcgagctctgataagggtcagactgcctcctcaagtgggtccctgacccctatgtatcctgactgggagacacctcccataggggccaacagacacctcatacagaagagctctcgctggcatctggtgggtgcctctctgggacaaagcttctagaggaaggaacaggcagcaatctttgctgttctgcggcctccagtggtgatacccaggcaaacagggtctggagtggacctccagcaaactccagaagacctgcagcagaggggcctgactgttagaaggaaaactaacaaatacaaaggaatagcatcaacatcaacaaaaaggacgtccactcagagaccccatctgaaggtcaccaacatcagagaccaaaggtagataaatccatgaagatggggagaaaccagcacaaaaaggctgaaaattccaaaaaccagaatgcctcttctcctccaaaggatcacaattccttgccagcaagggaacaaaactggaaacagagaatgagtttgaagaattgacagaagtagacttcagaaggtgggtaataacaaactcctccgagctaaaggagcatgttctaacccaatgcaaggaagctaagaaccttgaaaaaaggttagatgaattgctgactagaataaccgtttagagaagaacataaatgacctgatggagctgaaaaacacagcacgagaacttcgtgaagcatacacaagtatcaatagccgaattatcaagcagaagaaaggataacagagattgaagatcagcttaatgaaataaagcgagaagacaagattagagaaaaaagaatgaaaagaaacaaagcctccaagaaatatgggactatgtgaaaagaccaaatctacatttggttggtgtacctgaaagtgacagggagaatggaaccaagttggaaaacactcttcaggatattatctaggagaacttccccaacctagcaagacaggccaacaatcaaattcaggaaatacagagaacaccacaaaatcaatgtgcaaaaatcacaagcattcctatacaccaataacagacagagccaaatcatgagtgaactcccattcacaattgctacaaagagaataaaatacctaggaatacaacttacaatggatatgaagacctcttcaaggagaactacaaaccactgctcaaggaaataagaggtcacaaataaatggaaaaacaatccatgcttatgtataggaagaatcaatatcgtgaaaatggccatactgcccaaagtaatttatagattcaatgctattcccatcaagctaccattgacttccttcacagaactggaaaaaactactttaaatttaatatggaacaaaaaagagcccccgtatccaagacaatcctaagcaaaaagaacaaagctggaggcatcacgctacctgacttcaaactatagtacaaggctacagtatacaaaacagcatgatataccaaaacagatatatagaccaatggaacagaacaaagccctcagaagtaacaccacacatctacaaccatctgatctttgacaaatctgacaaaaacaagcaatggggaaaggattccctgtttaataaatggtgttggaaaaactagctagctatatgcagaaaactgaaactggaccccttccttacaccttatacaaaaattaactccagatggattaaagacttaaacataagacctaaaaccataaaaaccctagaagaaaacctaggcaataccattcaggacataggcatgggcaaagatttcatgactaaaacaccaaaagcaatggcaacaaaagccaaaattggcaaatgggacctaattaaactaaagagcttctgcacagcaaaagaaactatcatcagagtgaacaggcaacctacagaatgggagaaaatttttgcaatctatccacctgacaaagggctaatatccagaatctacaaagaacttaaacaaatttacaagaaaaaaaacaactccatcaaaaagtgagcaaaggatatgaacagacacttctcaaaagaagacatttatgtggccaaaaaacatatgaaaaacagctcatcatcactggtcattagagaaatgcaaatcgaaaccacaatgagatactatctcatgccagttagaatgatgatcattaaaaagtcaggaaacaacagatgctggagaggatgtggagaaataggaatgcttttacactgttggtgggagagtaaattagttcaaacattgtggaagacagtgtggtgattcctcaaggatctagaaccagaaataccatttgacccagcaatcccattactgggtataaggattataaatcattctactataaagaatacatgcagaggtatgtttactgtggcactattcacaacagcaaagacttagaaccaacccaaatgcccatcagtgatagactggataaagaaaatgtggcacatatataccatggaatactatgcagccataaaaaaggatgagttcatgtcctttgcagggacatggatgaggctgaaaaccatcattctcagcaaactaacacaaaaacagaaaaccaaacactgcatgttatcactcataagtgggaggtgaacaatgagaacacatggacacagggaggggaatatcacataccagggcctgtcagggggtagggggctaggggagggatagcattaggagaaatacctaatgtagatgacgggttgatgggtacagcaaaccaccatgacaagtgtatacctgcgtaacaaacctgcacattctgcacatgtaccccaaacttaaagtataataaaaattaaaaaaagaaatctaaacacagaaaaggtacagtaaaaatatggtatagtcgattttaaaaggtacacctgtagagtgtgtacttcatgcatggagcttgaaggacttggtgttgctctgagtgggtcagtgagtgagtggtgagcaaatgtgatggcctacgacattactgtacactactgtagaatttatcaatactgttcacttaggctgcactaagtttatgcaaaaatatttttctttcttcagtaataaattaaccttagcttactgtaaaaaaaaaaaaagtgaaaagttaatatttatgtgttctgtgttcaggaaaccaggaggaatggatttggctgaaactggaatacatggatagataaggctagagagataggcaggagccaagccaacaatactaggctcccatcaattgctggggcaggcaagagcaggcatcatcctgagtgtttggagcttcttttcatgttccctaagttggggggtgttggggggatgatacagggggaaattctgattaagacttaacatctattcctttgccttctcttcaagaagtcatacttgatgtccatccctcctggacagggtccgttctgtttgctgctaagctcctttcttatctctcccacctactgaacacgtactgtgttctgggagttttgaatgcatcatcttgtttatcctcatgagatggtctaataatgaagaaagcatgttttggcatccaactcacctgggtatgagtcccagctctgccttttactagctggatgtctttgagcagctcagttccctgttctgtgcttctgtgtcctcatctgtaaaatgggaacgacggctatttcttcagactgccctccctccctccttttctgtctccctccctccctcccttcctccctccctctttcccccttcttcttttcttttctttctctctttctttcttttcttctttccttctttcttttttctttctccttctttccttccttccctcctctctctctctctttatttctgtctgcctgtctttcaacagggtcttgctatattacccaggctggtctcaaactcctggactcaagcaatcctcccagcttggccccccaaagtgctaggattacaggcctgagcacctggcctggactttcttcagacttttcacagggtactagtgagaaaaaaatacatggactctgcttacttaatactgtgcctggcacattgtaagctcttcgcacatgttattgttattattcctcatcctaagggggaagtgcctttgaagggtccacactcctttgttacccaaattgggccaggttgcttaaactgccgttcttcagtagctaacaacaggggtgggagagcctggtcctctgaagtccagctgggcacacggccagtccctggcctgtccctgctcctgctgccctggcaaggcctccctcacccactggggctgcaccagcactggccccagctcagcttcctgtctcccttatcttcctccagcatgtgctctctggagtaggaaacaccaccgcttgcttccttcatttccctttgctcaacgggaccctcattctttaggtctcagtcaaatcccagctgctggcctggtgcccactctgtgattttctacacctcagccacccaggccagatgcagtgtaggccatggctccaacagcagcatttctcttttcttccccacccccatccctgggtttagaatgagaaaaggctcaagttgcccccctcccaacttccctacccgcaacactctttttattttctctgttcccagctccatacttccatgcttttttttttttttttttttttttttgagatggagtcttgttctgttgcccaggctggagtgcagtggcaggatctcggcttactgcaacctccacctcccgggttcaagtaagtctcccacctcaacctcctgagtagctgggattacaggcacgccaccatgcccagctaatttttgtatttttagtagagacggggttttaccatgttgcccaggctggtctcaaactcctgacctcaggtgatccatccaccttggcctcccagagtgctgggattacaggcatgcccagtcccatactttctgagttcaaatcctcgctctgcacttccaagctgtgtgaccttgggcaagttacttaactatttttctgggctttgattttttttttttttttttgtacagaggagcagaggaggattcatcaggttgcccaggttggtccaaactcctgggctcaagggatccttctgcctgggcctcccaaaatgctgggattacaggcatgagccaccatgcccagtttttttggttgttgtttgttttgttttgttttgtttgagacagggtctctttctgtcacccaggctggggtgcagaggcacagacatagctcactgcagccttgaccttttgacatcctgggctcaagccatactcctgcctcagcctcccaagtagatgggaccacaggtgtgtactaccatgcctggctaatttaaaaaaaatttttttgtagagatggagtctcatatgttgccatgctggtcactaatttacaggcatgagccactacacccaggcagctttattttatttatttttttgtctgtagcatggaaacaatgagcatggtctgccccagagaaagtgattaaaggcctagcacatagtatgaatttaaagaatgttttataacatatatattaaacattcaagcatgttggaggtatgtgttaaaaaaatgtattgatggaaagtgatcaaaataatttttgagtcactgtgtgggagttaaattcacaaactttggcaccagagagagagagaaactttcaaattatagcttttgctgtgtgaccttaggtaagtcacttaacctctctgagcctcagtttcttagtaaaatggtgatgctagtgaaacccatttcacagggctagcataagaataaagtaagattatttaagtaaagagccgaacactgtttctggcctacaataagtgttacctataataatgctatcattgtctcactgttcaattttcagggctctagtatatgagaggggtgcttgggaaatagctgttgctgctgctatctgtccatgatggatcttaacctgattagaaaggcctccatgtggctgggcgtgggggctcgtgcctgtaatcccagcactttgggaggccaaggcagatggatcacttgaggtcaggaattcgagaccagcctggccaacatgatgaaaccctatctctactaaaaatgcaaaaattagccaggcatggtggcacctgcctgtaatcccagctacttgggaggctgaggcaggagaattgcttgaatccaggaggtggaggttgcagtgagcagagatcataccattgcactccagtctgggcaacagagcgagactccatctcaaaaaaaaaaaaaaaaaaagaaagaaagaaaaggaaagaaagcccttgatgtaatgagctctgtgtaagataatgtggatgaaagtggacccagaccctacccgcttagatggaaggctcacagcattcaattccaaattggttcaatcgtacactcttttgccctctcttatccatcccaaagtacccttcaagccttcaagggagaaaaaaggcaaagcaaaaatatgcacaacctcactaagaaccagaaaaatgcaaactaaaaccaaagagaaatgccattttacacccaaccatctgataatgccaagggctggcaaggatgtgaagcgagggaattctcatacactgctgggaacgtaaattggcacaacctttctgtaaaacagtttggcaatatctagtaaaactgaagatgcatatactttattactcagaaattccactgtcaagtttgcacctacaaaaactcccacatatgcacaaggactcgagtatgagaatgttcataccagcactgtttgtaatagcaaaaaactggaaaaaacttaagtgttcagcaacaagagaatggatacataaataatgatctattcccaaaattgatttttttttttgagacagggtcttgctctgttgcccaggctagagtgcagtggcatgatcatggctcactgcagtctcaacctcctgggctcaagcaatcctcctacctcagcctcctgagtagctgagaccacaggcacaacccatcacacccagctaattttattttttttgtagagatgggggtctcactatgttgcccaggctggtcttgaactcctgggctcaaatgatccacccacctcggcctcccaaagtgctgggataatacctccccagccggaatattttaaagcagtgaaaatgaatggtctacacatagccacatgaatgaatcttattaatacattaagtgaaaaaagcaaaaggtacagaggaatacatacattttaataccatttatataaagctcaaaatatgtgaaataccactatctattgtttagggatatatacataagtagtgtaagtatacagaaatataaggaaatgaaaaatatcaaatcttcattttcatctgaagtggttacttcaggggctgtggcagggagagagagatgcagctgaggaagagtccatagggggcttcaactatattagcaatattgtatttcttatgcttggtggtggggataggtatgtttgaaatgtaatcctttaagcatgaaataactcttcaaaaatgaaatatttcaggctgtgcacagtggctcaggcttgtaatcccagcatgttgggaggctgaagtgggcggatcacctgaggtcaggagtttgagaccaacctggccaacatggtgaaatcccatctctactaaaaatacaaaaattagccaggtgtggtggcaggtgactgtaatcccagctacttgggaggctgaggcaggagaatcgcttgaatctgggaggtggaggttgcagtgagccgagatcacgccactgcattacagcaagactccatctcaaaaaaaagaaaaaaaaaaagaaaaaagaaatgtttcataatttttaataaaaggcaagacaatataaattggtagttatttaagtcattctacttttcctgaggcccagtgcaggaaaacaaagttcctatccttgttccaactagaccattttgataagctgcaaaaagaaaagactttgatgctatttcttagccagtttgcaacagctgagaggtgagcatggaagctcttgcatatattcagttcagagaatgggtgcttagtttatgtccagagtttgtcccagatttcactatgacgtcagctctccggggagaagtatataaaataaaaagttaaaatccctctcagtcctttacccaatcctattccccagaggtaatctctattgacagtacccctccagatattttccctatgtatatacaaatacacagatacacactgaaagttaattttggccaggtgcagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaattagctgtgattgcttcactgcactatagcctgggcaacagagctagaccctgtctcaaaaaaataataataaattttatatatatatatgaggatgaaattacatatgtattatttgaacagaagtgaaatcttttctttttttttttcagacagaatcttgccgcatgacccaggctagaatgcagtggtgtgatctcggccctctgcaacctccacctcccaggttcaagcgattctcatgcctcggtctcccaagtagctgggattacaggcatgcaccaccatgcccagctaatttttgtatttttcgtagagacgttcgccatattggccaggctggtctcaaactcctggcctcaagtgatctgcccacctcggcctcccaaagtgccagcagcatgctcggaggagtgactttaaagcttttctacttgcttcctagagtaagggacgcattttacactgctatccaaaactcatcatagaaacatacacacacaaaaccaaagcacacatatacaactgagcaaatatttcatgacataacactttctcttactaagggtgacgcgctgaaattttgtattctgtcctatttcattttttaaaaatggtaaccatgacctgctaaattgatttcattgtccactaataaattatgacctcagtttcaaaaagattgctttaggtaaccaatcatcttctgagatttatacagattgctcataattctctcctattttttaaaaacatgctgcagtgaactgctttacactcattttatgactacttctgagaccaagatcccggattatgtaattgttatttacttaaaattctggtaaaatgtagccattatactggaaaactaaattttaatcttggatctgtcaccaccatgatatataaactttgggcaagtccctgcacctctctggacctcaatctccccatcagcaacctgctgatcctactcccaggagtgtgctctaagttgaaagtagatgccccaccccctgagtcagcgccggcaggacttctcaccaagcccttctcccccttttccgctccctgttcctggttcctaggaagcagcccaaggagaagggaaaaggcaggtctgggcaggagggagcaatgaagggcggggcagagggagggcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggtgagtcgggggcacatctcctgcctcaggatggttctggagaatctcagtctatctgggcacatggcaagaccacaggagagcttatctcacagcatctgtgtctgcagctggctagatctctctacagggcaggcagagtcttggggactggttcgtgtcccaaagccaaggtgagttagtacatttaagcccctgaaaagggggagatgaaagaggctaggggaaacaggatgactggaaacatgagaaagaaaccagcagagagggtaggagaatcagccccagggagaggggagaaaggggaactgagggtgatggtagataggggtacatctaggggagacgggaagaggctcagaagagaagagaaatggagggaatgggaagaccctgggaaaactgatggaagaagtgggggaagagtggggcagagagaggttaggggaggctagggaaaatggaaggagactggtcgcagctggtggaactggggagaaagagatgctgtgcctaatagaacttatgggcgatcaggctactgaagtggccctgtttaagcagaaaagggagttattaccctccattataattgcacaggggcctcctttcccctctctcacaatccccgtaacttcagtctccccctcagagaggcagcaaataataaccagtattcaatgagtgctcactatggttaatacatgtattgacccatttaacttgcacaaacccctaaaggtgggtaatattattactatctccattttatgaggaggaaactgggtcacagagtagttaaggaccatgtctagggttatccataaatatacttattcacatctgcagatacaaagcacaacttctcaaatgcaaacacagacaggacccactcacacacacagatttacaaccccggactcatccaaatgtgctctgggcatcaactctgtgccagcctcttttctgggtgtaggaagcagagattaccaagcatggttccatagcctagaggagtccagtgtggcctgtgtgtgtttggagacagccaggtagtatcccgtgagatacacactaatatatggtggtctgggatcactgaaacagacacactgtgtctcgtggggcatcagaaaaaaatttccaagaagagggcaactgagctgggtctttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtatttttagtacagatggggtttcgccatgttggccaggctggtcttgaatccctgacctcaagtgatccgcccgcctcggcctcccaaagtactgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagccttgaatgccaggctaaagactctggacttgatcctgtggggaggcagtgtagcagaatggctgagtgctggacttgactgcctacgtgcaaaccttggctctgctacactatctctgtctcagtttcccatgtagactggggttaataatagtagctattgcattaagccactggggaaaggcacaaagataataatgtatgtaaagcccattgcccaggttataataagcactgaatcgacattggctatgattatttttgattaatgaaggggagggggttatggcactggaagattttaagtaggaaaaggacatgatctcatccctgggtcaggtggaggtcggaatagagaacggggagatgaagtagaaagttactaccccagtctagatgagacggatgaatcctgaatcagggcagtggaagaggagatggagaacaggcgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaagggtcgagaaggcgggcggccagcctcgaggtagggggttattatcttccgctgcccgccgccccctcccacgccggcccaggctgaagctgactctgcccgcaggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctgtgagtaggcgcgcagcgggggcggggtctgggcggggctagtgggggcggggcctggcgggtgggggcggggcctggcggatggaggcgggctgggacttgcagggacccggcagccactggagctcggtggcgcctgggcctttgaagattgctgggtgggggctggagagaggcagttgtccccgctaagaaagccccgactcgggcggtcgtcctgctggcataacctcttgggatagaccctgttggaaggccctgacaccgtgacgtcgaaggtccccagaaaactcctcacccctcgcctcacagtcctccaactccttttcttcatagatctccgtccttcccttcccacagcccccagcacttcaccccccaccctccagccacttctcatacaagctgatgacttcgctcttagctccactcatgacccgaactcttcccccaaagaccccaagttcttctctcaaagccccactccttccccgtcacaaccctaactccttcttctcaaagaccccaatttcttttctcaaagcaccaagcaccactccgtcccccttcccccaccatcatggcctttaactcctttctctcctagtcccccaccccaccccccttttttttttttttttttttttttgagacggagtcttgctctgtcgtccaggctggagtgcagtggcgcgatctcggctcactgcaacttccgcctcccgggttcaagcgattctcctgcctcagcctcccaagcagctgggactacaggcacccgccaccacgcccggctaattttttgtatttttagtagagacggggtttcgccatgttggccaggctggtctcgaactcctgacctcaggcgatccacaagcctggcctcccaaagtgctgggattacaggcgtgagctgccgcccctgccccagcctcaccccctgttttttttttctattacagttgaacaaggcctgacaattcccttttttcatcacagtccctggccccttctttcttagcctctaacaggctaaccccaaacccctcctcacagccccaggcccttctccccatagttccctgacctagactcccctctcctcacagcactgactcttgccttctcatgttcttttccccttggtgggcctcgccccacacctggcaccctctctgcacagtcccctgaccctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaaggtatgatgggacggggcccaggcctgcaagctggggagagggcgggttccagacaaatggatggacctgaaggatggatgcctagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcattgttatctcctccactttgcaaaatttctggaaaagtaacctatacccatttcttctgcttccttatttctcactcattctttttttttttttttttttttttgagacagagtcttgctctgttgcctaggctggagtgcaatggtgtgatctcagctcactgcaacctctgcctcccggttcaagcaattctcctgcctcagcctcccaagcagctgggattacagatgcatgccaccacacccagctaatttttgtatttttagtagagatggggtttcaccacgttggccatcctgacctcgtgatccgcctacctcggcctccccaagtgctgggattagacgtgagccactgcgcctggtcttctcactcattcttagacccagtgcaatctgacttctctataaactactctgagatcaccagtaacctctaattgtcaaaccatcaccctacatggtatctgcaaatttgcggactagaactctctttttgccttaacttctgagataccatacttcaatttttaaaactgttctgtctactttttttcaatccctttgactatgtcatcttacacgattcaccctggaaatgctggcttccttagaattccattttttggttccttttgttcctgtttgaactataccctttctaggtgacctactgaccttcatggctgcaaatactatctacctgtggtttccatggagaagcaatataattttatctttaagagcatgtgttttgtcggccaggcgcggtggctcacgcctgtaatcccagcactttgggaggccgaggcgagaggatcacttgaggtcaggagttcaagacaagcctggccaacacagtgaaaccctatctctactaaaaatacaaaaattagctaagtttggtggcacgcgcctgtaatcccagctacttgggaggctgaggcaggagaatcacttgaacccgggaggcagagtttgcagtgagctgagatcacaccactgcactccagcctgggcaacagagtgagattctttttttttttaattctaaaaaaaaaaaaaaaaaaaaaagagtatgtgttttgtcatcagacttaagttttacttctttgaactagaaatttaacttcttcaagtctcagttttttttttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccacctcggcctcccaaagtgctgggattacaggcgtgagccaccgcgcccggcctaagtctcagttttttttgttcccaaatggtattaataaaatataccaaagggtctaagaaaaacaatacccaattcataaaggcatgaagagtattaaataaaagtatatatgtaaaataatatgccaagcgcaagctgggcacggtggctcatgcctgtaatcccagcactttgggaggccgaggcgggcggatcacaaggtcaggagatcgagaccatcctgactaacacagtgaaaccctgtctctactaaacaaaaacaaaaaattagccgggcatggttgcgggcgcctgtagtcccagctcctcgggaggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaacgcaatgactggctcacacctgtaatcccaacactttgggaggcagaggcaggaggattgcttgagctcaggggtttgagaccagcctagacaacatagtgagaccctgtctctacaaaaaaaaatagaaaaaattagctgggcatggtggtgtgggcctgtagttccagttactcaagaggctgaggtaagaggattgcttgagcccagaaggttgaggctgcactgagccatgatcgtgccaccacactgcagcctggcaacagaccaagaaaaaaaaaaaaagatagtgtatgtatagtcagtaaatacagcagtggcttctgatctccagacctctcatttgcattgattctttaaaatcatctctaccttaatgttctgtagacatttcaaaatcaacatgttcaaaatcaaatttattatctatctccccaaatctgctctctctacttctgatgtttactgttcattaatggataacagaataaccatcaaatcatgtaagtggagagaactcagtgttaacctttatttactccctcttatttatccccatctaccaactacagtatctataaaacacattcactcctttctaccccattgcttttgttcaagatatcataattcctctctttctttgtggtaaacatgaaggtgtaccatccagttctacctccaaagaaagacttcctgttggccgggcatgatggttcacgcttgtaatcgcagcactttgggaggccgaggtggggggatcacctgaggtcaggagttggagaccagcctggccaacatggcgaaaccctgtctctactaaaaatacaaaaattagccgggcgcggtgatgcacgcttgtaatcccagctactagcaggggctgaggcaggagaatctcttgaacccaagaggcagaggttgcaatgagctgagatctcgccactgcactccagcctgggcaacaagagcaaaattccatctcaaataaataaataaatacataaataagaaaaaaaagacttgccgttcagctatagggggaatagccagcagatagcttccgcttgcttcagttctttcaatgtctgcctcagctgtagaggacagtcctgcacaagatcatgcccatcccagggctgccctcactcggtgcctaagcaaggcaggggtataaaagttcggtcattttggccaactgcaggacaactctgagaataggttggattgacaagggctagccagggctggaaatattcactccagagctccctgccagggaggctgggtctttgtcagatctgcattgccgtttgacttctctcttagctcagccctacttcttccccctggtaagcatcttgcacctcaaactctgtctcagcctctgcttccagataacccaacttgtgtgtgtgtgtctctctctctttcaaaattgagaaattttctcaatcttgtctggaccatggcagcagcctcctcctaagaaattgcctctaatttctccatattttaattcatcttctacatggcagtaagaaacacagatctaattgtgtcattattccgttttttgttgttgtttgttttttgttttttgttttgttttgttttgttttgagacagagtctctctctgtcacccaggctggagtgcagtagtgtgaacttagctcactgcaacctctgcctcacaggttcaagcaattctcctgcctcaacctcccgagtagctgggattacaggcatgtgccaccacgcccggctaattttttgtatttttagtagagtcggggtttcaccatgttggtcaggctggtcttgagctcctgacctcaagtgatctacccgccttggcctcacaaagtgctgggattacaggcgtgagccaccacgcctggactgttttttaaatttctcattgagttaaattcagaatcctcaaaatgacattcaaggccttgcacaatgtggccccaacctaattttctaatttaattttaatttaattttattttattttattttgagatggagtctcactctgtcacccaggctggagtaaagtggtgcgatctctgctcactgcaacctccacctcctgggttcaagctattctcctacctcagcctcccaagtagctgggattgcaggcatgtgccaccacgcccggctaatttttgtatttttagtagtgacggggtttcaccatgttggtcaggctggtcttgaactcctgacctcatgatctgctctccttggcctcccaaagtgctgggattgccggcgtgagccactgtgcccggcccctcaaattttattttctaccatttctctttagccactgtgccttagattatttattttaaaagcatatttttaaatgacggaagtggtacaacaacagcaataacagagaagtttacaaagaaatttcataaaggaaaaacggaacgcctcctgctttctcattctccccaaatccttactccagaggtatgctaagattattagttgcaagcaacagaaaccaattctgccaacttaaggggaaaataagtatattggaaggttattaagtaatcctcagagttgatgggaaagccagataatcaagctcagaaagtagaaccagggaccacagccaaagtcacaccacaggaatggtattaaggatgccacagctggaagcactacctccatcaccaatgctgctgccatattaaaggaattctcctctgaccctgtgtctttacatcatttgttcaagagtcaatatcctgagtggaagcagccaaatgaccaagccttgatcatgttgcttttgccttagctgcaagtgcaggggggaaaaggaaaactttagatacctttgacttctcttgtgggaggtgagaacctgtctcccattaagactcacacagaggaagagatttcagatgctgggcaaccaaaacaggtacaggtgattttaaagaattgatgcaaatgagaagcctggagatcagtagccactgctgtatttactaactctacatatattatcttttttttgagacagactcttggtctgttgcccaggctggaattggtggcacgatcatggctcactgcagcttcaacctcctgggctcaaaaaacagaacaaaagaaaaataaaatagaaaagcaaaaacaacaaaaacccataaatgttcactatatctcacatcattaatttatttactcgtttaataaatgtttgtcagaaacttccatatagaaggctttatgttatgtactttggaagacacaaaacgattaggatatgatccttctcaaggagcccagtcttttcttgggaagataaaacatacaaaagagaacaacacaaggcaagatgcattgtataactagaagaaacacacaaataaaaatgtgatgttatgtggccgggcatggtggctcacgcctgtaatcccagcactttgggaggctgaggtgggcagttcacctgaggtcaggtgttcgagaccagcctggccaacatggtgaaaccgtctctactaaatatacaaaaattagccaggcatggtggcacgtgcctgtagttccagctactcaggaggctaaggaaggagagtagcttgcacccaggaggcagatgttgcagtgagttgagatcgtgccactgcactccagcctgggcgacagagcgagactccgtctcaaaaaaaaaaaaaaaaaaaaaaaaaaggaaagaaagaaagaaaaatgttatgctctgatttactcttgtagctatcatttacatattgctatatagtttttggaattctgtaacttgcgtttatcatttaatactctctttggtcttgtaagatagatataatcattttagattaggagacatgtttagggagaataagaaagttaataactgatatggtttggatgttttgtccctccaaatctcatgttggaacgtgacctccattgttagagatgggcataatgggaggtgtttgggtcatgggggcagatccctcatgaatggcttaacaccatcctttagtgttgagtgagttcttgttcagttagattacacatgagatctcgttgtttaaaaggatctgagacctcccctcctctttcttgcttccttctgtctcatcttatatgcctgctccccctttgccttccaacatgattgaaagcttcctgaggcctcaccagaagaagatgctggtgccatgcttcctgtacatcctgcagaagtgtgagtcaaaaataaacctcttttcttttataaattagccacttgcaggtattccagtatagcagcacaagaattgactaatatagtatcagagctaggattcaaacccgtgcctttgtgttctaggatttatgctttctctcctctactaaaactgcaggaatcagaggaatctaggggagaaacatggtatttgtgaattggtgagatatgaccatgcccagataggaaagatagacagaacagattcaataatgaaaataggaaaaagcagagtaaattttagacatttcttaaagaagatacaccagtggccaataagcacatgaaaagatgcccaacatcgttatagtcattatggaaatgcaaatcaaaaccatgagataccacttcataccatcaagaatggctataggaggatggatagaatcaatattgtgaaaatgaccatactgccaaaagcaatctacaaattcacgcagtccccatcaaaataccaccatcattcttcacagagttagaaaaaacaattctaaaattcatatggaatcaaaaaagagcccacatggccaaagcaagagtaagcaaaaagaacaaatctggaggcatcacactacctgatttcaaattatactataaggccatagtcaccaaaacagcatgatactggtataaaaataggcacatagaccaatggaacagaatagagaacccagaaataaacccaaatacttatagccaactgatctttgacaaagcaaacaaaaacataaaagtggggaaaggacacccttttcaacaaatggtgctgggataattggttagccacaggtagaagaacgaaactggatcctcatcttttaccttatacaaaaatcaactcaagatggattgaggagctgggcgtggtggctcacgcctgtaatcctagcactttgggaggccgaggcgggcagatcacgaggtcaggagattgagaccatcctggctaacacggtgaaacccatctctactaaaaatacaaaaaattagctgggcgtggtggcgggcgcctgtagtcccagccactcagaaggctgaggcaggagaatggcgtgaacccaggaggtggagcttgcagtgagctgagatgacgccactgcactccagcctgggtgacagagcgagactgtgagactctgtcacaaaaaagaaaaaaacacaagatggattaaggacctaaacccaagacctgaaactgtaaaatttctagaagataacattggaaaaacccttctagacattggcttagccaaagatttcaagacaaaaaaaccaaaagcagttgcaatataaataaaggtaaatagctgggacctaattaaaccaaagagcttttgcacggcaaaaggaacagtcagcagagtaaacagacaactcacagagtgggagaaaatcttcacaatctatacatctgacaaaggactaatatccagaatctacaatgaactcaaacgaatcagtaagacaaaaaaaaaaaaaaaaaaaatcaatcccaacaaaaagtgggctaaggagatgaatagacaattctcaaaagaagatatacaaatagccaacaaacatgaaaaaatgctcaacattactaatgatcaggaaaatgcaaatcaaaaccacaaagcgataccaccgtactcccataagaatggccataatcaaataataaaataatagtagacgttgacgtggatgcagcaatcagggaacacttctacactgctggtgggaatgtaaactagtacagctgctatggaaaacagcgtggagattccttaaaaaactaaaagtagagctaccatttgatccagcaatcccactactgggtatctaccccgaggaaaagaagtcattattcaaaaaagatacttgcacacgcaagtttatagcagcacaattcaccattgcaaaatcgtggaacaaacccaaatgcccatcaatcaatgaatggataaagaaactctggtatatatatatgatggagtactactcagccataaaaggaatgaattaacagcatttgcaatgacctggaggagattagagactattattctaagtgaagtaactcaggaatggaaaaccaaacatcatatgttctcactgatatgtgggagctaagcgatgaggatgcaaaggtataagaatgatacaatggactttggggacttggggcaaagagtgggaggggggtgagggataaaagactacaaatatggtgcattgtgtactgcttgggtgacgggtgccacaaatctccaccaaacaacttactcatgtaaccaaatgccacctgtacctcgataacttatggaaaaataaaattttaaaaagaatggctataggaaaaaagacagacaataacaagtgttggcaagaatgtgaagaaattggaaccctcatacattgctggtggcaatggtatagcactttggaaaacaatttgacagttcttcaaaaagttaaacatagagttattgtgtggcccagcaagtccgctcctagtatatgcccaagaaaattgaaacatacatccatgcaaatacttgtacatgaatgttcacagaagcattattcctaatagccaaaaatggtaataatccaaatgtctgttaattgatggagaaacaaaatgtagtattttaatacaatggaatattatctagccatgaaaatgaggtactgacacatgttacaacacggatgagccttaaaaacatgataagtagtccgggagcagtggctctcgcctgcagtcacaacactttgggaggccaaggcgggtggatcatgagatcgggagttcaagaccagcctgaccaacatggagaaaccccgcctcttctaaaaatagaaaattagccgggcatggtagcacatgcctgtaatcccagctactcgggaggctgaggcgggagaatcacttaagcccaggaggctgaggttgcggtgagccaagatcgcgccattgcactccagcctgggcaacaagagtgaaactccatctcaaaaaaaaaaaaaaaaaaaatgataagtaaaagaagccagtcacaaagaaccaggtattatatgattcaacacacgtgaaacatccagaataggcaatctgaccaggcacagtggctcatgcctgtaatcccagcaatttgggaggccaaggcaggtggatcacaaggtcaggagatcgagaccatccttgctaacatggtgaaaccctgtctctactaaaaaaaaaagtacaaaaaagagctgggcatggtggcacgtgcctataatcccagttactcgagaggctaaggcaggagaatggcgtgaacctgggaggcggaggttgcagtgagtggagattgcgccactgcactccagcctgggcaacaaagcaagactctgtctcaaaaaaaaaaaagaaaaaaaaatagcaatagctgtttaagtcagtggcctgcaaaacatgttaacaattaggtcaattccttctttgcgcttcctcaatccatagtttgatctatcttcctccaaatctgctctgtcactcaggctggagtgcagtggtgtgatcccagttcactgcagtctccatctcgcaggctcaaacgatcctcccacctcagcttcctgagtagctgggactacaggcatgcacctccaagcctgcctaaatttgttttgtttgtttgtttgtttgttttgtagagtcagggtttcaccatgttgcccaggctcgaattcctgaactgaagtgatccacctacctgggcctgccaaagtgctgggattacaggcatgagccaccacacctggcctgaacacgcttatactaatggtgaaataatgttgggtagctgtaagtggcttgcccaaagttccacagtgatgtggtacaagaactggcactagagcttgggacttctgacttctgatcctgagctattgctgctacatcattccatgagaggcattaggaatcataggttaaagaggtaaggtactacttggagggattctctgaaaatttttgcccatgtccaaaagcaggagaggtaagtaatcagggaaacagtgggatgaataactctgaccgtttagggagaagatatgatcctcatttccaggagtttctacacagggtgaagagtgaatggaaggttcatctgcttatgcttacgtatgtgaatacatgttcatagctacatgaccttagataagtcagtgcccctctctgagagggagtttgtaatctctgagatatctaaggtatctcccagctctgataactaggattctacattcctaagtccagatggctgacaggacaattgtaaaggtcctagaagttccattcctctttttgggaatgatcttagaatgtttggcttgggtcagttacgtggcagccagactattagagctccagttggagtttacaagagaaataaacaaatctgaaataaaggtaaacaaatgactccctggcatattctaaaagtatccttctgggtggcttggcttactggattccccatcttttaattcagttcaacacgtgtgccttgattttatatctctgccaggtggcctgaggtttaggttttggaccgcattctttttccaactcagccaactgttgctgaggactgttttatgcaaagaattgtgctaactgctagcagggatgcaaaagtgggtaaaacatgatctctgcccaggaactgatagtctagaaggagaagcatacaaagcagtttattttaacacagaaggaatgaaaagattcaaagtaattataagctatgtactgaaagaaagagatctgggaaggctacacagaggccatagatttcatctggggcttgaagaagagaattacagtaggtgaaaaggggaaagatgtttctcctttcctagactaagatctttgagggcagagattacatcttatttatctctgtgttcctgatacccaacatagtgcctggcacaaggaaagagtccaatacatgtgttttgaatcaatgaataatgagtggattctagactgatataatagcacaaagacaaagtggataaaagtgcaccttatgtttggggaatgctaaatggtctgatgtggttgctccgaatattggttatataaggaaatgttatgggaaatcaaattttagtaccagattaagaatgccatgctaagaagttatacttagtctataggcaatagttaactatttactcctctaggacaaaatacccttgggttgtgggaagtcagggaccccgaacagagggacctgctgaagccgtgacagaagaacataaattgtgaagatttcatggacatttatcacttccccaatcaatactcttataatttcctatgcctgtctttactttaatctcttaatcccatcatcttcataagctgaggatgtatgtcacctcaggaccctgtgatgattgcgttaactgcacaagttgttcataaagcatgtgtgtttgaacaatttgaaatctgggcaccttgaaaaaagaacaggataacagcgacgttcagggaacaagggagataaccattaggtctgactgcctgggagctgggcaggacagagccatatttctcttattaccaaaaatgggtaagagaaatatagctgaattctttccccagtaaggaatattaataattaacagccctgggaaaagaacgcattccgggggggggcctctaaaatggccactctggaggggtgtctgccttatgcagttacagataagggatgaaacacaccctggtctcctgcagcgtccccagacttgctaggattaggaaattccagcctggcgaattctagtcagaccggttctctgctcttgaaccctgttgtttatcaatgacaatgcatgcacagtgggacatggaacttcattaataattctagtttcgccctgaccttgtgatctcgccctgaccttctgccttgtgatcttttgttgcccttgaaacaagtgatctctgtgacccacaccctattcgtacactccctcccctttgaaaattgctaataaaaacttgctggttttacggctcagggggcatcacggaacctgccgacatgtgatgtctcccccggacacccagctttaaaatttctctcttttgtactctttccctttatttctcagaccagccaacacttagggaaaatagaaaagaacccacgttgaaatatcgggggctggttcccccaatacccttgttcatctttgtatccttagtatctacaacagtgccaggaatttagaagttagtcaataaatggctggatgaatgaatgaattgaagagttttgaggaaggaaattatttcatccaatctgcaccttactttactgataataatccctcgcctttttgtacaattttgtagtcacagaaacattttatcctattatgtcatgaaaaattttattgatatgctcaaaaagcttattaggaaagaaaggcagatattattatcatttcctatagatgttattattctcatttcctggcaacgttattattctcacacccagtaaaaagaaaccaaaactctatttcttctaatatctcttggtatatccgatgatctgttgtatgtgtactggcatataacagggttctcatgggtagccttaatcttgcatcacactcactataatcaggatttctacatatcccaaaaaatagatccaactcgcaatgcagggatattgtactgattacttcatggggatcctggctgtaccataccccacacagcagaagcttaatcaattcttagacatttctgttctttttcttaagcttgatctctctcaacatcaacgaacttatctctcttccttctctttcctctcacaaccttgcccccttttcccacccaaacaaaaaacaaaacccattattttattaagcctttcatttttcagtatgtttatttttctcagcaaaacaaaagccctgtagtttttcttatttccttaaacatggtgttttatttcatccaaatgcaagtgaagaggagattagatttggtttgtggaattccagggaacagattaatgaatgagaggaagtcagagagaaataaatgttagtttaatgtaactttctgacccagcaattcaataatggaactggctgtttcacagagtagtgaactccctgttactggaagtatttggcatgtcaagtccaacttctgacctctaaaaccgcatgtgaccgtcctacatatgttcaaagatgatggtcctgttctcctaaatcttttcttctttttttgagacagagtctcgctccgtcgccaggctggagtgcagtggtgtgatctcggcccactgcaatgtctgcctcctcagttaaagtgattctcctgcctcagcctcctgagtagttgggactacaggcacgtaccaccaggcccagctaattttcatatttttagtagagacagggtttcaccatgttggccaggatggtctcgatctcttgacctcatgatccacctacctcagcatcccaaagtgctgggattacaggctgtgaaccaccgtgcccagcaatcttttcttctccagattaaacatcttactttcttcaagggttccttatttgatgtggcagttcagtaacctgctattgttcttctggacttgttacaatttgtcaatttctcatgcatttatttaaaaaaatttattgagtcgggtcactagaattactaaataagaaaaagaaaattattgagtgacttctatggttcagacgctgttttaggacgtgggaatagagcaatatagcagagaacaaaaacaaagtctgtcttagaagctacagtttactgggagggacagaccctaaacaaataatttttttttaatgtcagagataattagtaggaaataggtagaaaaataaggaaggtcgaagggagaataactgagttgctgttttagacagcataatcagggcaggcctctggaataagatgacagttgagcagagatatgaaggaagtgcaagagtggccaggggaagaacaagccaatttagatagaccgaacaagtgcaaaagctctgaggagtaagcttggtttatttcatgaacaaggaggccagtttatctgaagtggtacaggcaaagagaagagaaagagcaggaggcaaataaccgagggcctaataagccaattatctgtactttgctatttgttctgagtgagatggaaaggcattggaggctttcgagaagaggactgacgtgatttgacttgcatttgaaaagcatcactatggctaccatggggggaaacaaagtttaaaaggcaaagaaatactcagggacctccaaggatactcatacattcctgttaggaggcaataatatgggtgaaaaatgatggtggcaaggacaagggtgataccactacttacccattacccatcagaatagtcagaaagaaaaagacaaacaaggaaggaaagaaaagacagtattggcaaggatacaggccaattagaactttcctacactgctgttggtaaggtaaattgatatgaaacaaccactgtttagaaaaccgcagtatctactaaagttgaacatctgcctcctaggcatatgcctaacagaaacgtttacctatgttcactgaaagacatatacaagattagtcatagctgtaagaattaaagaaagaagagagaaacacgaagggcggctcgacagtcaacagggacaggtttattctgaataaacttgagtggggcagctggccaagttaggtcagagccacactctcttacagactaagtgtttttaaggattcagggtgggagaatttatcagaggcttggactgcttctgtgtttctttgttgtgcttatctgggagggaaagttgtgtgtctgttcccatacatctttctgcagctgcaggcatatcccccgggttgcttttagcttccctatcttagtgcacctgaagggaaaggaatgtgcttattagggcctactgttttactgggagccatcgtatgagggtgaagtttggcagttacccaggagactttccccccacctccctctgtacccaagctgtcttatctatgttttactgtctgctctttctatttgtacttagaagagagtgatttccttgaaatgcacgaggctagaaagggagctggaacttaaagtggcagtgtttgttcgagatgacagtgctcctgctctgtcaatagcagtattctttgtaatatccccaactaaaaagtacccaaacaccatcaagaatagaataatgaaacaaattatactatatttacataatggaatatacaacgagagtagaaaaacttaaactacaagtcttaatataagtgaatgtcacaaatataatattgatcaaaagaagccaaacacaaaaaagtataaactatatgattacatttatataaatttcaaagacacacagaactaacctgtggtgttagaagccaggatattggttacatttgggaagctaatgattagaagggagacatgagggcttctgaggcaatgccctgtttctttctttcttttttttttttttttaagatggagtctcgctctgtcaccaggctggagtgtagtggcgcaatctcggctcactgcaacctccacctcccaggttcaagccattctcctgccacagccccccgagtagttgggcctacaggcgcatgccaccacgcccagctaatttttgtacttttagtagagacggggtttcactgtgttggccaggatggtcttgatctcttgacctcgtgatctgcctgcctcagcctcccagagtgctgggattacaggcatgagccaccgcacctggcctgccctgtttcttaatctggatgctggctatatcaataggctcactttgtgaacattcactaagttgtacatttataatttgagcactttcctgtatcagtgttatgcctcaataaagtttacattacaaaggaatgactcagaggttttgatctgtgcaactggaggctataattgacatttattgaaatggggaagctatagaagaagcaggttttggtgggaaatgcattcattatgtacatactacatttgatatttattagacatccaagttgaaatgctgatagaatgcagttggtatacaagtctgcagttgagggaaatgtctaggctgaagacctaaatttgagagctcactatatagataacatgtaaactcataaagctggatgggatcacctaaggaatagtctagacagagaaaacattcaagtactaaaccctgaggacgccccaacatttaaaggctggaaattgaggagaaaccagtaaagaaaactgagtagccagtgaggtgtgataagagctgagagagtggaatctcagaagccaggtgaaaaaagtgttctaaggaggaagtaaccactgtaacagatacagcagatagtggaataaggtaaggactgatcatcggttattgatggagatcactggagaccttgataaacagcagttttggtggtgtggtagggacaaaagcctaattagaatgagctcaagaaacaaactaatttgagacagtgactataaataactcttttgaggagtttggtttgttttacagaagaacagagaagtaagatattaaaaagaatattaattaaggatatgaagcagtgttgggttaagtaactaaggaggcttatgggatcaagaaaagttttttctcttaataaggtagataataaagtatgtttgtacacttacagggataatcaatagagagggaaaatttgatgacacaagaaaaagagagggcagtggctggagtgatgtcctggagcaggttataaaagaggttagactccaaggcacaaatggagagaccaacttagctaagatcatggacagttcctctagggaggaaagagctagagaaagggatcccttaaatctgtacgtgagccaagagaaattgcaagctcactaccaagttgcacatgtgcttggtaaaaagaaagcttggtaatggctttgataactcaactgtaatataaatcaccatctgactgtcagactaaccccagagtggcatggggtagattcaaacagcctagcaaagactctgaaaatgaactgacactgcaaccacccacagcaggtgagacaaagcttgtagtctgaaactaattgagttatttgcctgctaaaataaactagtcaccatccagataatttaaacaggactcagagtcccacaatctaacactcaagatgggcaagatacaatccaaaattacttaatatacaaagaaccaagaaactgataaatgtttaaaggaaaagaaaacaaatagatgctaatccccaaattatttagatgttagaattatctgacaaaaactttaaagtagctattataaccatcccccatgaggtaaaagttaaacatccttgaaataaatagaaaggtagaagttcttagcagagaaatagaaattatgaaaaagaaccaaatagaaattatgtgaagtaaaaatatttgctgcagagctcattagtagaatggagataacagatggatgaatgaatgagtgaatttgaagatagatcgatataaattattcaatataaagatcatagagaaaaaaatattttaaaaatgaacagtctacagatataccatcctgaatgcacctaatcttgtctaatttttgaagctaggcagggtcaggcctggttaggatttggagggagaccacctgggaatactgggtaatgtaggctgtcaattaaaaaaatgtttttaaacaatcagacacctactatgtaccgataaaattttgtaataaaaaaattcaaaaagtaaacgagaataaataagaataaagaatgtgatgttggccaggagtggtggctcacacttgtaatcctagcactttggaaggccaaggtgggtggatcacctgaggtcacgagtttgagaccagcctggtcaacatcatgaaaccccatctctactaaaaacacaaaaattagccaggtgtggtggtgcttgcctataatcccagctactcgggaggctgaggcaggagaatcacttgaactggggaggcagagattgcagtgagctgagattgcaccattgcactctagcttgagtgacagagcaagagtctgtctcaaaaaaaaaaaaaaaaagaaaaagaaaagaaagaaagaaagaaaaagaacatgatgttttagatatatattaaaaatagtctgggcacagtggctcatgcctgtaagctcagcactttgggaggcagaggtgagcagactgcctgagctcaggagttcgagaccagcctgggcaacatggtgagaccctatctctactaaaaatacaaaaaattagcacagtgtggtagcatgcacctgtagtcccagctactcaggaggctgaggcaggagaatcgcttgaacccaggaggcagaggttgcagtgagccaggattgggccactgcactccagcctgggcaacagagtgagactgcctccaaaaaaaaaaaaaaaaaaaaaaaaaaattaacagagcctcagatacctgtggaaaaatatcaaaagctctaatattggtgtcatcaatatttctgaaatagaggagaaagagactgatgtggaaaagtatttgaagaaatgatggctgaaaacttcataaatttggttaaagatacaaatttacagaattgtaaagctcagtgaaccccaaaaggataaaagcaatgaaaaccccacccaccctaatcaaacttctgaaaaccaaatattaggaaaaaaattttaagagtagccaccaaaaaatcacatgttacatatgggggaacaataattcttatgactgtagatttttcatcagagaccatggaagccagaagacaatggaataacacctttaaagtgctgaaagaaaagaactgtcaacttgaaattttctatctagtgaatattccctttgagaataaaagtgaaataaaaacattctcagataaagaaagcctaaaagaatttgtctccagaacacctgttctgaaagaaatgctaatagaagccaaagtgaaataataccaaaaggaaacttggaactacagaaatgaaggaagagcaacagaattggtatatatctggataaagttaggttatttttctctccttacataaagttatttatgatcattgaaagaaaaaattataacacagtctaggagagtttcaatgtatgtagatgtcatggataggacaattataaacaacagggggaaggtaaagggacccatatacaggcatacctcattttattcattttcccatcgtgttttgtagatattgtgattttacagattgaaggtttatggggcaagtctatcagtgccatttttccaacagtatatgttcacttcctgtctcttgtatcacattctggtaattcttgcagtatttcaaacttgttttttcttttgtagagacaaggtctcactatgttgaccaggctggtcttgaactcctggcctcaagtgatcctctgcccttggcctcccaaagtgctaggattacagatgtgagccatcgaacttagcccaaactttttcattattattatatctgatgtggtgatctgtgatcagtgatcttggatgttactattgtaattgttttggggtgtcacaaatcacacctatataagatggcaaacctatagttgataaatgtagtatgtgtctggctgctccactgaccacctgttccctcacctttctccctcttcttggccctccctattctgtgaggcaatatacattgaaattaggccaatgaataaccctacaatggcctctaaatgttcaagtgaaaagaagagtcacgtctgtgtgcggtggctcatgcctgtaatcccagcactttgggaggccgaggtgggcggatcacaaggtcaggagttcgagactagcctggccaacatggtgaaaccccatctctactaaaaatacaaaaattagcctggcatggtggcagatgcctgtaatcccagctactcaggaggctgaggcaggagaattgcttgaacccaggaggcaggggtcacagtgagccgagatcgcgccactgcactccagcctgggggacagagcaagactccgtctcaaaaaaaaaaaaaaagaaaagaagagtcacatacatctctcactttaaatcaaaatcatgatatgattaagcttagtgaggaatgtacatcaaaagactagataggtcaaaagctaggcctcttacaccaaatggttagccgagttgtaaatgcaaagtaaaagttctcaaagaaaattaaggccaggcgcggtggctcacacctgtaatcccagcactttgggaggccaaggcaggtggatcacgaggtcaggagattgaggccatcctggctaacgtggtgaaaccccatctctactaaaaaaaaaaaaatacaaaaaattagctgggcatagtagcgggtgcctgtagttccagctactcgggaggctgaggcaggagaatggcgtgaaccagggaggtggagcttgcagtgagctgagattgtgccactgcactccagcctgggtgacagagtgagactctgtctcaaaaaaaaaaattaaaagtgctactccggtgaacacatgaatgataaagtgaaacagtcttaatgcttatacagagaaagttgtagaggtctggatagaagattaaacaagccacaacattcccttaagccaaaacttaatctagatcaaatccctaactctctttaattttatgaaggctgagagaggtgaggaagttgcagaagaaaagtttgaaggtagcataagttggctcctgaggtttagggaaagaagccatctccagaacataaaagtacaaggtgaagcagcaagtgctgatgcggaagctgcatcaagttctacagaagatcgagctaagatcactgatgaaggtggctacactaaacaacacattttccatgtaggcaaaacagtcttctattggaagaagatgccatcaaggactttttttttttttttgagatggagtctcactctgtcacccaggctggtgtgcagtggtgcaatctcagctcactgcaacctccatatgctgggttcaaacaattttcctgcctcagcctcccaagtagttgggactacaggtgtacaccaccatgcctgcctaattttttgtatttttagtagagatggagtttcaccatgctgaccaggctggtctcgaactcctgacctcatgatctgcccgcctcatcctcccaaagtgctgggattacaggcatgagccaccatgcccagccagccacctaggacttttatagctaaagataactcattgcctggattcaaagcttcaaagcacaggctaactctcttactaggggataatgcagctggtgattttaagttgaagccaatgtccatgtaccattatgaaaatcctagggccattaagaatgatgtgaattctctgcctatgctccataaatggaacaacaaagcctggatgacagcatatctgttcatagcatggtttactggatattttaagcctactgttgagacctactgctcaggaaaaaagattcctctcaaaatattactactcattggcaatgcacgtggtcacccaagagccctgatggagatgtacaaggagattcaggttgttttcatgcttgctaacacatcattcattctgcagtccatggatcaaggagtaacttcgattttcaagtcttatttaagaaatacaggccaggtgcagtggctcacgcctgtaatcccagcactttgagaggccgaggtgggcggatcacagggtcgggagttcaagagcagcctggccagcatagtgaaaccctgtctctaataaaaatgcagaaattggccgggcatggtggtgggcgcctgtagtcccagctacttgggaggctgagcaggagaatcgcttgaacctgcgagtcagaggttgcagtgagccaagatcatgccactgcactccagcctgggcaacatagtgagactgtgtctcaaaaaaaaaaaaaaaacatttcataggctagagctgccatagatagtgatttctctggatgatctgggcaaagtaaacaaaaagccttctggaaatgattcaccattctaaatgtcattaagaacagttgtgattcatgggaggaggttaaaaatatcaacattaacagaaatttggaagaagttgattccaaccctcatgaatgactttgagaggttcaagtcttcagtggaggaaggaactgctgatgtagtggaaatagcaagataactagaattaaaagtgaagcctgcaaatgtggctgaattctgtaatctcatgataagactttaattaatgaggagttgcttcttctggataaacaaagaaagtggtttgtcaagatagaatctactcctgttgaagatactgtaaacactgttgaaatgacaacaaaggatttagaatattacataaacttagttgataaagaagcagccagaattgagaggattgactccaattttgaaagaagttctactgtgggtaaaatgctatcaaacaccatcacatgctacagagaaatattttgtggaaggaagagtcaattgatatgcaaactttattgttgtcttattttaagaaattgccacagccactccaatcttcagcaaccaccacccttattagtcagtaatcatgaacactgaggcaagaacctccaccagagaaaagactatgactcaccgaaggctctgatgattgttcagatttttaagcaacaaagtactttttaactaaggtatttacattttagacaaaatgtcattgcataacactgtatgcaatgtctaatgtaattagacataatgttattgcacatttattagactataatatagtataaacacaacttttatttattattgtttttctttttagacgaactctttgctctgtcgcccaagctggagtgcagtagcaatcttggctcactgcaatatgcacctcctgggttccagcgattctcctgcctaagccactttggtagcagggattacaggcatgttgccaccatgcccggctaatttttgtatttttagtagagacggggtttcaccatgttggccaagttggtctcgaactcccaacctcaggtgatccacctgcctcggcctcacaaattgctaagattacaggtgtgagccactgcacccggccttaaacataacttatatatgcactgggaaaccaaaaaccttgtgtgattcactttgttgcaatattcactttactgaagtggtctagaactgaacctgcaatatttccaaggtatgcctgtagttgtgagatgtcagtgttttacttgaagtgttaaaacattgattttaagttgactgttaaaattaggtatgtgtattattatccctagatcaacagctaaaaaaaaaaaaccacaaaagatatagacaaccaatatattaaattggaatataaaacatattcaaataatccaaaatataacaggaaaggggacattgagaggcaaaaaaatggaggagacaagcagaaaaataacaaattgtagaccaaaatccactcttatcaataactacattaaatgtaaatggtctttaaaaatgtaaatggtctaaacacaccaattaaaagacaaagatggctgggtgcggtggctcacgcctgcaatcccagcactttgggaggccgaggtgggctgatcacctgaggtcaggagttcaagaccagcctggccaacatggtgaaaccccacctctactaaaaatacaaaaattagccgggcaaggtggtgcatgcctgtaatcccagctactcgggaggctgaggcatgagaatcgcttgaacctgggaggcggaggttgcagtgcactgagatcatgccattgcattccagcctgggcggcagagcaagattccatttcaaaaaaaaaagacaaagatcatcagattggaaaaagaaaaaaacaagacccaactatatgctattacattttattttatttttacttctcaaatgttaaggaaacctattttaaatataaagatataaatatagggaaattacataatgataaaagggtcaattcaccaagaagataaacactgaaatataatatgcaactaacaaagatccaaaataaatgaagcaaaaattgatagaactaaaagagatatggaaaaatccacagtcataactgggagactcaataagtccattctcaatgactgataaacaaatagatggaaatcaaaaaggatatatcaaacctggataacgttatcaactggtttaatataatggacatttacaaaaaacactctacccaagaacaacagaatacatattctttccaagtgcccacagaacatatacccagatagatcatattctgggtcataaaataaactaacaatttttaataaaaccacataaagcatgttctctggctataccaaaattaaacaagaaataaataatagaaaactcccccagcctaaccaacatggtgaaaccccgtctctactaacaatacaaaaattagctgggcatcgtggcgggtgcctataatcccagctactcgggaggctgaggcaggagaattgcttgaacctgggaggtggaggctgcagtgagctgagatcacgtcattgcattccagtccaggtggtagagcaagattccatttccaaaaaaaaaaaaaagacaaagattatcggattggaaaaagaaaaaaacaagacccgactatatgctatcagcaagaaagctattttattttatttttacttctcaaatgtcttatggtttaaggaaatctattttaaatataaagatataaatatagggaagttacataatgataaaagggtcaattcaccaagaagataaacactgaaatatagtatgcaactaacaaagatccaaaataaatgaagcaaaaattgatagaactaaaagagacatggaaaaatccacagtcataactgggagacttcaataactctgttctcaataactgataaacaaatagatggaaatcaaaaaggatatataaaacctggataacattatcaactggtttaatataacggacatttataaaacactctactcaagagcaacagaatacatattctttccaagtgcccacagaacatatacccagatagatcatattctgggtcataaagtaaactttaacaatttttaataaattaaaaccacacaaggccgggcgtggtggctcacacttgtaatcccagcactttaggaggctgaggcagtggatcacctcaggtcgggagttcaagaccagcctgaccaacatggtgaaaccccatctccactaaaaatacaaaactagccgtgcatggtggcacatgcctgtaatcccagctactcgggaggctgaggcaggagaaccgcttgaacccaggaggcagaggttgtggtgagccgagatcatccacataaatggtgttctctggctataccaaaattaaataagaaatcaataatagaaaactcccccagcctgaccaacatggcaaaaccctgtctctactaaaaatacaaaatgtcattgcataacattgtatgcaatgtctaatgttattagacataatgttattgcacatttattagactataatatagtataaacataacttttatttattattgtttttctttttagacgaactcttgggcgtgatagtgcgcgcctgtaatctcagctattcaggaggctgaggcaggagaattgcttgaatccaggaggtggaggttgcagtgagctgagatcgcaccactgcactccagcctgggtaacagaacaagactctgtctcaaaaaaaaagaaaaaaaagaaaaaaaagagaactctcaaatatttagaaattgttaatatacttctaaataatccatgggtcagagaaaaaatcttaaagtaaatcagaaaatatttgaactgactgaacatcaaaacaaaacatatcaaaatttatgggttgcagctaatgcagcgtgtacaggaacatttatagctttacatgcctatgatagaaaaaagaaaggcctcaaatcatactctaagcttctaccttaagaaactagagaaagaacaaattaaacctaaatcaagcagaagaaaaagaaattagaaaagcagaattcaatgaaattgaaaacagaaaaaaatagagaacaatcaataaaaccaaaagctttgaaaaggtgtacagaattcataaactttttgacagatttaccaaggaaaagaaagagagaagacataaattactaatatcaggaatgaaagaggggatgtcacttcagaccctccagatattaaaaggataataagagaatattacaaacaactctatgctcataagtttgacaacttagaggaaatggaccaatttcttgaaagacacaaattacctaaactcagtccagaagaaacagatcagagaaatagtcctaaatgtactaaagaaaatttaattcatagtttaaaaccttccaatgtagagaagaaaactccaggcccagaaggtttcttttcttttccttccttcctccctccctccctccttccctccctccctccctccttccttccttccttctctcttttctttccttttctcttttcttttctttccttttctttcttttctttgtggcagggactcactcctgttattcaggctggagtacagtggtgcaatcacagctcactgcagccaagacttccacacccagcaaatttttttgtatttttagtagagatgggttttcatcatgttgcccaggctggtctcgaactcctggctcaagcaatctgcctgccttagcttcccaaagtgctgggattacaggcatgcgccaccatgcctggcccccaaatggtttcactgggaaattctaccaaatgttaaagaaagaaatagtatcaattccacacaaactcttccagaaaatcaaaaaaacttagctcattttatgaaggcagcatggtcctgatgccaaaatttgaaaaagataacaagaaaactatagaacaatacttcacatgaacatataccccaaaacttcaacaaactacaaactattagcaaaggaatccagaaatatatatatatttttaaaaaataatacttcactactatgtggagtttatcccaggtaatttaatgctggtgtaacattcaaaaatagccaggcatggtggctcacgcctgtaatcccagcactttgggagggtgaagcgggcagatcacctgaggtcaagagtttgagaccagcctggccaacgtggtgaaaccccgtctctactaaaaatacaaaaattagctgggtatggtggtgtgcactagtagtcccagctacttgggaggctgaggcaggagaattgcttgaacccgggaggtggaagttgcagtgagctgagatcgcaccactgtactccagcttgggggacagagcaagactccatctcaataataataataataataaataaatgagcataattcaccatattggcagactaaggaagaaaaaaacacatgataatcctaactgatgaagaaaatgcattaacaaaatttaaaacccattcatgataaaaaaaaaaaaatctctcagcaaactagagaaggaaacttcgttaatccaaaaatatatatatatattggccgggcgcagtggctcacacctataatcccagcactttgggaggccgaggcaggcggatcacctgaggtccagagttcaagaccagccttaccaacgtggagaaacctcgtctccactaaaaatacaaaattagccgggtgtggtggtgcatgcttgtaatcccagctactcgggaggctgaggcaggagaattgcttgaacctgggaggtggaggttgcagtgagccaagatcatgccattgcactccagcctgggcaacaaggacaaaactctgtctaaatatatatatatatatatatatatatatatatatatgtatatatacacacatatatatgtacatatatacatatatctacatatacatatatacatgtatacatatacatatgtatacatgtatatatgtatatatgtgtatgacctccggtgatcccccccccaacctcggcctcccaaagtgctgggattacaggtgtgagccactgcacttgaccgcaaatcacatttctaacaaaggacttgaatccagaatttattttttaacatttttaaaaaattttattttattttatttttggtagagacaggatttttgtatgttgcccaggctggtctcaaacttctgacctcaagtgatcctcctgctcagcctcccaaagcactaggactacaggcatgagccactgtgcctggcctagaatttataaagaaccctcagtagggcgcagtgcctcatgcctgtaatcccagcactttgggaggctgaggcaggcggatcacgaggtcaggagttcaagaccagcctggccaacatagtgaaacctcgtctctactaaaaatacaaaaaaattagccaggcatggtggcaggcacctgtaatcccagctactcaggagaatgaggcaggacaatcacttgaacccgggaggcagaggttgcagtaagccaagatggcgtcactgcagtccagcctgggcaacagtgtgagactctatctcaaaaaaaaaaaaaaaaaaaaaaactctcaaaactcagaaataagaaaacaaacaattttttaaaaaggcaaaagttttgaacaggcacctcaccagagaagatacatggatggcaaataaatatttgaaaatatgctcaacatcatttgttggtagggaattgcaaattaaaaccacagtaaggtatgtctatacacctattgaaattgaaaaaaatccctgacaataccaattgttggtgagaaggcggaacaactgccactctcataaattactggtgggaaaacaaaatgatacagcccctctaggtttcttataaagttaaacacacacttaccataggctccaacaatccctcctagaaattagcccaagtaaaatgaaaatttatgttcataccaaaacctgtacgtgaatgtttacagaagctttattcataattgccaaaactagaaacaacctaaatattcctcaactgggaagtggagtaacaaactgtggtacatccatacaatacactactactcagcaatgaaaaggaattgactactgatacactcaacaacatggatgaatcttaaatccattatgccaagtgaaagaagccaaattcaaaatacaacatattgtatggttccattttatatgacagtctggaaaagaaaaaactataggaatagagaacatatcagtgttgccagggcttaagggtagggaaggctttgactacaaaggggtaacaaaagggaatttgggaaggtgattaactgttttatttttttgtttgtgtgtggtggtgtttacataattctttgcatttgtcaaaactcacagaactctacaccaaaatgtaaattttactgaatgtaaattacaattaaattatatgtatgcaaatctattatgtgtatgtttgtgtatatatatatatatatatatacacatatgaatatttttaaaagctttttcccctcatattactatcaagtcatatctcacagattttgtatttgtacaattattctttcttgagcctgaaattagttaggactgttttgttttgtttttttcttgagatggagtcttactctgttgcccaggctggagtacagtggtatgatctcggctcactgcaacctctgcctcccaagttcaagtgattctctggcctcagcctcccgagtagctgagactacaggcgctcaccaccacacctggctaattttcatatttttagtagagacggggtttctccatgttggtcaggctggtctcgaactcctgacctcaggtgatctgcctgccttggcctcccaaagtgctgggattacaggtgtgagccaccacgcccggtcaagttaggactgtcttcatctctgttaaccttccatttcctctccttccacaaaacctaaactttattattatttgaaacataatttttgagtaagttattccgtctcaagaaggtccaattcgtgttattgagaatggtaaaataatacactacctgccctgggcactttagtgagaatccatttattgggttaactagcagtgactgtggatggcagtgagcaggcctgggagtggccaggacataggacagatgtgctttgatgggagagaagggaaggaaaagccggcagcacagcgatgggaaactagaggccagaggtagaggtggagggcaatgatcagggagcagagatgacagcatgccaaggacatcctgtgctgacttcacaggctggctctgggcataggccagtctcttcctggagctttcattttctctcttcggaatctgtcaactctctactgcaatctgttccacagtcgtatagccaaaatcctcttgctctgtgtctgtttattcaacaaatatttatcttaactgactctaatcacattgtctcctgtttgtcctgcagtgaagcccttttacatctgcttatctcttttgatccaagggaaggagacttaaccctgacttccagagaaggaaatagtctcagaaaggttaagtcatttatctgaagttgcccttttaatactgagtactggactctctcagtatccgcgtactctgctgccccctaccgtgaacatagcaataggttttaaatcacaaaaacacacagcagaacactacacaacactggaaagactacgacactataaatagtgcttacatttgttcatttagcaaatattcagctggacgtggtggctcacgcctgtaatcccagcactttgggaggccgaggcaggtggatcacttgaggccaggagttcaagaccagcctggccaacatggtgaaaccccacctctaaaaatactaaaattagccgggcatggtggcacgcacctgtaataccagctactcgggaggctgaggcaggagaattgcttgaatccaggaggcggaggctgtagtgagccgagatcacaccactgcactccagcctgggtgatacagcaagactccatccccaaaaaataaataaacaaatattaattgagagcctactatatgccagaaataagcaggtattgtccttgtgttcatggagcttatggtgtagagggggagacagaattacacaaaataattacttaattacagtttgaataaatactatgaagtacaaggtgctatatgagggtatagaataagggtatgtagcctggtctggaggcttagggaaatcttacatgaagtagaattcataggaataaattattggttggctatgggggaggttaaagagacatcaagaatgccttccaggtctctggcatgaacaactgggcagatagagcactgttactaagcaggggaagcctagaggaggaagacattatgaatggaaagaatatgaacttggctttggctttttgcagttcgggaatcccacgagacattaaggtatagatgtggaataagcaatcagattcaggagtttgggagcaaggtctatgctagaaatagaaagttgggagttgttgggatacagattatatttgaaactgtggtcatggatgacatttcttagaaaataatagaaagagtagaaggcttataacttccctgagaaactccagaatttaaaaggtcaactggaagagatggagctagcaaaaacttaggacaaggggccaaggaggggaaaatcaggaatgtgcaatgatgccaaagtcaggggaagtgtatttcaaaaagaagactggtcaaccatggtggtaattacaaagaaatcaagtgcaatgactttcttggtctacgatgatttttttggtctgcctagtgaaacagattcagtttcagaggactagaggtggagaagactaggccactacctcttagaaaacctcctaaaggccaccatagcctatggtcttgaaccagtggtcttcatagtcttttgctcacataccacttaaaataattttgataaataatgtgagctgggcacagcggctcaagcctgtaatccaaatgttttgggaggctgagtctggaggatcactggaccccaggagtttgagaccaacctgggcaacatagagaaactccatctctacaaaaattaaaaaattagccaggtgtggtggtgtgtgtctgtagtcctagctatttgggaggctgaggtgggagaattgcttgagcccaggagttcaaggctgcagtgagctataatcatgccactatacttctacctgggcaacagagcaagaccctatctctaagaaaataaataaataaaatttttaaaaaacattaggccaagtgcagtgactcatacctgtaatatcaacactttgggaggccaagatgggagaactgtttgagcttaggaattgaggaccagcctgggcaatatagtatgacctcatctctatgaaaaatttttaaaaattaggtgggtgtggtggcacacgcctgtagtctcagctacttgggaggctgaggcgggaggatcacttgaactcaggagattgaggctgcagtaagctacggttgcgccactgcactccagcctgggcaacagagcgagaccctgtctcaaaacaaacaaacaaaaatatagacatatttttaaaagataatagaaggctattttctgaatcttgtatttttaactgtccccagttctgaacttttttttaattgccccgtgcaatgtatcattcagggtgggtcagatatatgcctttctttcttttcttttttccatttttttttttttctctgagatggagtctcactcttgcccaggctagagagcaatggtgtgatctcggctcactgcaacctccacctccagggttcaagcgattctcctgcctcagcctccccagtagctgcgattactggcacgtgccactgtgcctgactaatttttgtatttttagtagagacagggtttcaccatgttggccaggctggtcttgaagtcctgacctcaggtgatccactcacctctgcctcccaaagtgctgggattacaggcgtgagccaccatgcctggcctttcttatgaagactagcagaactacaattatgaagaaaaagtcggcttggagcctcaaccccaggaactttctcaggtggagtacatctggaagttgaggatctggaaatgaatttccttaaatatatccatgcatgagtaccgcttaccaagccttcatttactttacggctattgcataccccatttgaaaaccagtgttgcaaaggactgggggcaatctgaaactactgggttcctggaacctggcactgattgatggggccagtgggccctaatgagattgcacctccattttaaaagcgtgaaaggtataaggagattcagagataggtgtaaatggcttgcgggagcctccaaaattttcaggtccaggtacctcccaccccttcaagggactgtctgatactattctatggctcctggaatgaagaaccagtcatcaggacctgctggcctctattaaattaagagtccagtcagatttaacaacctgaagatgaggtgtaactgtgaagcaatatatggctgattttttaacacacccatccaaatacatccactccagctgattcattctctcaactcccatgtgctaggtaatgtatgaggtgccagagttacccaaaaaacaaacaaagcacaatccataggccaagtcctgcagaaactctaggagagaaacttttaaagaaataattataaaaacactgtgatcggctgggcgtggtggctcacgcctgtaatatcagcactttggaaggctgaggcaggaggatcacccgagatcaggagtttgagaccagcctggccaacatggtgaaacaccatctctactaaaaatataaaaaaattagctgggtgtggtggctcacaactgtaatcccagctacttgggagactgagagcaggagaattgcttgaacctaggaggcagaggttgtagtgagccaagatcatgccactgcactccagcctgggttacaagagtgaaactctgtctcaagaaaaaaaaaaacaaacactgtgataaagagttaataaaactatgtgcaagagctaggggagtactgaagaaagagtgatttgagtaagaactttgtaagactttgagtaagaactttttaagactttgggaaaacttcccaaaggaggtcacattagagttatttattggcaggcgtgtagtacatcatagagaaaaagagatggcagtggaaggatgttccaggcagaggatgcagcatgtcacatgggcagccagtgtccaagtgacactcaaggggcaagacctgcttcatggacttgtgacctctgtagtcacacagggcccccctcttagaagggccctcacgcttgttttaatgttctgctgtcatcattttgaaattcttattttttttttaacaaggagacttgcattttcatttttgcactgggccctgcaaattacgtagcaggtcctgcaagagggcaagatgaaggcagggagacctgctgggaagttattactgcggtccaagtaagagataatgaaggggctaaatcaaggtcttgtcgtaacagtaatacacagccacaccattttcaacttcttcccagtgtattcctcagtttagatgtagcaatttccccaactggaaagtacttaggttgattttggtgttttgtaattacaaagaatgaggcaattgaataatttgctacaaataattttgtgtttgcacctatgcaaggatatctatctaggataaattctcagaattagaattgatgggtcaaaggtatgctcattttcaaggttgataggcattgccagttggtgacctgaagagagtaaaccaatttgtatctcttccaacagtatggaggagtatctgttttatcatgccctctttaacactctgtagtatccaaccttttggtatttgcagtctgataatgttaagaaagcagtggctgattgtcttaatttgcctttctttaattacaaacatggttggtcatttaaaaaattattataggagtctgttcaggccaggcacagtggctcacgcccataatcccagcactttgggaggccgaggcagatggatcacttgaggccaagagttccagatcagcctggccaacacggcaaaaccgcgtctctacaaaaaacacaaaaaaattagtcaggtatggtggcatgtgcctgtagtcccagctacttgggaggctgagacatgagaatcgcttgaaccaaggaagcagaggttgcagtgagttaagatcgtgccactgcactccatcctgggtaacggagcgagactgtctcaaaaaaaaaaaagagtccatttatatttctgtttgcatgaagcccatttagtccttcgccattattgaattgggtcataggtctttttcttattggtttataacagctgttttacgttaaaaaaataataataaatattttacctagtttatagtttgttgctttatttctgctttttttttggccatgcagatgaaggcctgaatttttgaaacctaagtgaactgttactgctttcactgtataccagtattttgcaatataagccctcttttcagggagtggcctttagagactattacacttatttttttagaagctcagcttgttcatttggagaacatacaatattaaagggaaaaaatgctcagcttgtacttattttttgaagagataatatatccacatgattaaaaagtcaaaagatacaaaaaggtatacagtgagaaaaatctccttccagccaggcatggtggctcccacctgtaatcccagcacttttgggaggccaaggcaggcggatcacatgaggccaggagttcgagaccagcctgcccaacatggtgaaacactgtctctactaaaaatataaaaaatagctgggctttgtggtgtttgcctgtagttctagctacttcggaggctgaggcaagagaattgctccaacccaggaggcagaggtttcggtgagccgagactgtgccactgcactccagcctgggtaacagagcgtgactccatctcaaaaaaataaaataaaataattaaaaaaaattaaaaaataaaaataaaaattgccttcccaccctgtcctcaaaccacttaagcttccctccaggaagtaagcactattatcagttccttgggtatctgtccctattttatgtgtaaatgagcaagtgcatgcacacacatgtattcttttttccgattattacacaaatagtagcctacaatatccaggattctgcacctttgccttttttttaccacttaacattacattttggaaataatgtcctaattattcataaattcgtaagtacttcctcattttaaaaaatggctgcattgggccgggcgcggtggctcacgcctgtaatcccagcactttgggagtccaaggcgggtggatcacaaggtcaggagatcgagaccatcctggctatcacggtgaaaccctgcctctactaaaaaaatacaaaaaaattagctaggcgtggtggtgggcgcctgtaatcccagctactcgggaggctgaggcaggagaattgcttgaacccaggaggtggaggttgcagtgagccgagatcgcgccactgcactccagcctgggcgacagagcgaaactccatctcaaaaaaaaaaaaaaaaaattacaaaaggctgcatagtgtcccattgtatgcattggtttgaatatgcttttaagggagaaacctgagtaagaaatactctcaagtcatttggggctggacattgagactgagtcgggggattggactgggaccttctctagatcctgaacaatcagaccttttccttcctccaggcctttacctcccattttctttttctttttttttttttttttgagatggagtctcactctgtagcccaggctgaagtgcagtggcaccatctcagctcactgcaacctctgtctcctgggttcaagagattctcctgcctcggcctcctgagtagctgggattacaggcacgcgccaccaagccaggctaatttttttgtgtttttagtagaaacggggtttcacccatgttggtcaggctggtctcaaactcctgacctcaagtgatccacccgcctcagcctcccaaaggtgctgggattacgggcgtgagccacagcgcccggccttttaccctccattttctgccaattaaaacttcacacagtcttccattgcttgtaacttttgaacacgtgtgtggtaatgttctgtgtatattgcatataaaactattagcttttaaaatattaccagtttatatagactcatctcaaatgctacttccttttggaaaccttccttgatctccctgatatccccagccagagtgacctcactcccctctgaaatcctatagaatggtgtaatgttttgtggttatttgtcacgccttttatgtgcacaagtcttatcttttttttttttttaacctgaagacggcctcacttgccccagtaccttccacagagtggcttctgagtaatgtttacagaatttttgaggtaattaatgaatgaacaaaggcaccaagggttaaggacatgaatttagtgtcagacacttgggttctactcctggttttgctgttttttaggtgtgtcgtggggtaggtcacttctctcaccctttccttagaatccacttcacaggacagtggtgaggattaagtgatttgatgtaggtaaattgcttttcattgactgttagctgctgaaataggaattcagaggaaggaggagagaggtcaaggagacttcctaagctggactgtgctctccagccaccctctcatttatatttcctttcagatctctactaagaatgtcactctggccgggcgcagtggctcactcctgtaatcccagcactttgggaggccgaggcaggaggatcacttgaggttgggagttcgagaccagcatgaccaacatggaaaaaccccgtctctactaaaaatacaaaattagccaggcgtggtggtgcatgtctgtaatcccagctactcgggaggctgaggcaggagaatcacttgaacccgggaggcaggggttgcggtgagccgagatcacaccattgcactccagcctgggctacaagagcgaaactctgtctcaaataaataaataaataaaacaaaataaaaaataaagaatgtcactcttccttgttcctgcattttctttttatgtctttatcttttgggtaaatttgcctggcttcagggcgaaggccctccagcaccaagagctgcctagtactgcagattcttacgaccactcaaatctttctttcctttataagaaacaagcaactctaccctatggttgagccaatgtgtcagtttcttcctatccaaatggatggcatcctgacatctgcagtgagaggccaatgcaatttggtgggggtaggggcaagggtgggggagttttgcagagcataaagagcacagtatcttggatcttcagcagcttgagttcagttcttaacttttcttgcctcattacaacagtgtcacaacccattttcctcatacattgagaactgctgcagtcaggcacggtgactgttacatggctgttatattggccatggatggccaacatagtgagacctccattttaaaaaaaaaattaaaattagtcaggcatgatgacacgtacccgtagtcatagctactcaggagactgaggtgggaggatcgctcgagcccaggagtttgaggttgcagtgagctatgatcatgccagtgcactccagcctgggtgacagagtgagatcctgtctctaaaaaaataaaaataattagaaagaatatgattggaaaaaaataaaaatacaagtaaaaataaaaaagaactcttgtgaggaaagcatctaacaatgctagacaaaaagtaagtaaccaacaaatgcaagttctccctttaagctcttctccacactggtaccagatttgtactgctaaaagtcctgttctttcctcttattatggaggaattatcctagctcatagccaacctcctcactcatatacatgcttactcaagggcatggcttcagcagttctcctctctctcctgcatcatcaatttttccctctctcctggatcagtctcaatcaacatacaaatgttatgtttcccatcttaaaaacaaacaaaaagtctgttttgactccactaccaactacagctgccacattttctccttcttctttgtagtaaaacttcttgaaaaagctataacctgtatactcaacattttcaattcctcttgaacctactccaatcagatttttgtcccatacactccaccaaaacatctcaagatcaccaacaacctccacattggtaaatctaattaccttctattcatcttcatattatttgatctgtgtgacacagttgattactctctctttcttaaaacattttattcacttggcttccgggagttctcactttcctggttttcttctttttggctcttccttctcagtgtctttggctgattcctcttcattttcccaacctctaagtattagagttgccccaggatccagtcattggaactctttgcttttctgtctacactcatttcctaagtaatttcttcagtcccttgggttttacatattatattgattctgaaaacctccaaattcccacttcactctcaaccttcttcctgaactcaggtccaaatatcaaaatagcctacttaccacatccacttgggtgagctcttcatatttctactcaaacctgtccctcctgcagtcttctttgtgtcaaataatggcaactccattcttctagttgctcaggtcaaaaagtttggtaattggtgaacacgccgtccacgtgcgccttgctgtctctccattatcgcttgagatctccagccttaccgcggcttgaaatggaccccaactgctcctgcaccactggtggctcctgcacgtgcgccggctcctgcaagtgcaaagagtgcaaatgcacctcctgcaagaagagctgctgctcctgctgccccatgggctgtgccaagtgtgcccagggctgtgtctgcaaaggggcgtgcagctgctgtgtctgatgtggggacagctcttctcccagatgttaatagaacaacctgcacaacctggttttttttccttaatacaaccctgagccatttgctgcatttcttttcatattaaatatgtgaatgacaataaaacaattttgacttgaaaaaaaagtttggtaattggtaatgtgactctccgctttgtctcatacctcctatccaatccattaacaaattctgccaactctactttcaaaatctatgattccaaaaaaatccaaaaaaagtgtaaagggaaaaaatacaaaatacaaaaaacaaaaaattaaaaatcaaagtctatgagaatccaactacatctctgtatctctacttggacccaggtctgagccgccatcatcttgtacttggattattgtaatagcctcctaactggcctttctgatatggtcttaaaaccttttctcagcccagcaaccaaagtaattctgttaaaacataagccagaagatgtctcttccactctcagaacctctcatcagtttttgttaagagacagggtctcactcttgctcaggctggagtgcaatgcaatgatgatcacatagtttacgacattctcaaagtcccatgctcaagcaatcctctcacctcagcctcccaagtagccaggactacaggtgtaccccaccattcctgggtaatttttttttgtttttggtagagatggtgtcttgaactcctggcctcaagtgatgagtgagagtatcaggagatgacagatgatgatcaggtgagaggatcaagagactgtcctacctcagtctcccaaagtgctgggattacaggcatgagccaccatgcccagccccatcagttttttatctcatgtagaccacccttccctccataaccttcatctcctgatactctcactctcttccactctaaccacagtgattcttacccttttcctcaaacctaccaggcacgttcttgcctcaaaacttttgcatttgctgttccgtctgcctggattcatttctttcagatatctacatggttcactcccttgttcctccagatctttacaaaaaactcacttttttactgaggccttccctggccactccatccaaaaattttttttttttctctctctctctctctctcacacacacacacacaccattcagatttcaagtcctaaatcctgcttttctcaacagaaaaaaaatgctatttaactacatatatatatttaaatcattttgttcgttgtctatcaccccagtttttttgtttgtttgtttttgttttgttttgttttgttttttcttttgagacagagtctcactctgtcacccaggctggaatgtagtggtgcgatctcagctcactgcaacctccacttcccgggttcaagtgattctcgtgcctcagcctcctgagtacctgggatgacagatgtgcaccaccatgcccagctaatttttgtgttttttagtagagatggggtttcaccatgttagccaggctggtcttgaactcccaacttcaggtgatctgcccaccttggcctcccaaagtgctgggattacaggtgtgagccaccatgcccggcctgctccattataatttaagttccatgaaagcaggaagtgttattagatttgttcaaagctctatcatcccagtaccgagaataatgttcaacacaaaataggtgtttcacataagtatttgttgaacttgtttcttgagtgaaatcaaacgttatcattttgctcctctgttttgggtcattctgcccagaacagagtactcatgccttttggtctcaggaccctctctacactcaaagtattgagggccagacacagtggttcattcctgtagtctctggtacttgaaaggctcaggtgggaggatcacctgagctcaggagtttgaggttgcagtgagctatgattgtgccactgcactgtagcctgggcgacagggtgagaccctgtctcaaaaaaaaaaaaaaacaaaaacattcaggctgggcttggtagctcatgcctgtaatctcagcactctgggaggccgaggcaggcagatcatgaggtcaggagttcaagaccagcctggccaacatagtgaaaccccatctctactaaaaatacaaaaaattagccaagtgtggtggctggcacctattacgtaatcccggctacttgggaggctgaggcaggagaatcgcttgaacctgggaggcagaggttgcagtgagccaagatttcgccactgcactccagcacgggaaatagtgcgagactctgtctcaaaaaaaaaaaaaaaaaaatttcaggactccaaataacttttgaaaattcaggactccaaataacttttgtttatgtggattctgtctattgataagtatcacactagggatcaaaactgagaaattgttaaatatttacatactaattcatttaaaataacaataataaacatgttaacataacatttttatttttaaaaaaataataaaaatttagctgttttgttccaaaacgaaacaaaaaaaatagtgagaggaatgctactgttttgcttttttgaaaatctgttttatgtctggtttaatagaagataattgtattatcctatttacttctcattcaatctgtataatgtgccatgaagccctggaaaactacccagtactctcatgagaaaatgagagtttaaaaagaaaacaatgtcttcgtattattatgtaaatggttgttgtctccatatatatctgttgtctttgtacatagttttccctcccattctacatagcaaactcctgctggtcactcaaggtctgtctcacctgccatctctagacagtcagttgttccctcctccctactcccatttctctattatagcacatattatgttatcttgttatctggataattgtctatcttcccaaccgactatcttcctaaagaaggcaactataacttgatcttctttacatccctagccccactcacagtatctagcaccaaaaagatatttaataaatattagttgaataaagaaatatgaggccaggtgcagtggctcatgcctgtagttctagcactttgggaggccaaggcaggtggatcacctgacgtcaggagtttgagaccagcctggccaacatggcgaaaccccatctctactaaaaatacaaaaattagccgggcatgttggtgggtgcctataattccagctgctcaggaggctgaggcaggagaaccgcttgaacccaggagacggaggttgcagtgagccgagatcatgccacttcactccagcctgggcaaaagagcaaaactccatctcaaaatatataaataaatatgaaaggaggtgaagggaagaggggacccagtttatctacagtgagctcaggcactgatataacatttcttttttttcttttcttgagacagggtctagctctgttgcccggactggagtgcagtggcataatcacagctaactgtaatctctgcctcctggcctcaagtgatcctctctcctcagcctcccaagtagctgggactacagccatgtgccacaactcccagctaaatttttttttttttttttttttttgtaaagacagagtttcaccatgttgcccaggctggtcttgaactcccgggctcaagtgatccatcctccttggcctcccaaagtggtaggattacaggtgtgaacaactgtgcccagccaatatcataattcttttcttttctttttttttttttcttttttgaaacagagtctcttgtcgcccatgccagggtgcagtggcacaatcttggttcactgcaacatctgcctcccaggttcaagcaattctcctgcctcagcccccaagtagctgggattacaggcgtgcaccaccacgcccggctaagttttgtagagatggggtttcaccatgttggccaggctggtctcgaactccagacctcaggtgatccacctgcctcagcctctcaaagtgctgggattacaggtttgagccactgcgccagccccaatataatatttcttgttaagattatcagtgtcaaaggttttccaacatcacactctggggactgttgtggggtggggggaggggtgagggatagcattaggagatatacctaatgctaaatgacgagttaatgggtacagcacaccagcatggcacatgtatacatatgtaactaacctgcacattgtgcacatgtaccctaaaacttaaagtataataataataataaaaaaagaaagaaaaaaacaaacaaccccattaaaaagtgggcgaaggatatgaacagacacttctcaaaagaagacatttatgcagccaaaaaacacatgaaaaaatgctcatcatcattggccatcagagaaatgcaaatcaaaaccacaatgagataccatctcacaccagttagaatggcaatcattaaaaagtcaggaaacaacaggtgctggagaggatgtggagaaataggaacacctttacactgttggtgggactgtaaactagttcaaccattgtggaagtcagtgtggcgattcctcagggatctagaactagaaataccatttgacccagccatcccattactggctatatacccaaaggactataaatcatgctgctataaagatacgtgcacatgtatgtttattgtggcactattcacaatagcaaagacttggaaccaacccaaatgtccaacaatgatagactggattaagaaaatgtggcacatatacaccatggaatactatgcagccataaaaaaatgatgagttcatgtcctttgtagggacatagatgaaactggaaatcatcattctcagcaaactatcgcaaggacaaaaaaccgaacactgcatgttctcactcataggtgggaattgaacaacagaacacatggacacaggagtgggaacgtcacactccggggactgttgtggggtggggggaggggggagagatagcattaggagatacacctaatgctgaatgacgagttaatgggtgcagtacaccaacatggcacatgtatacatatgtaacaaacctgcacattgtgcacatgtaccctaaaacttaaagtataataataataataataataataataaaaagcttttcctagcagctggtcagtttaccatatagttcattaagtgaattccaaccactcatgtggtctttcaagtgaagtggagaagacagaggtcattcatttcattttatgaggcaaccaaggcccaaataaatgaagtgacttgctgaaaggcataccaaaagtcagtgacagagccagtgcttgaatcaggtatctgacgttaagtcaagtgctgtttccattttatcccatgctcatcatggtgactggaggctgcaaagtcagagttcccgtgattctatcttggggtgttgctctgaaaccttctaaacctcctcttgaactgatttcacagcagtctctggaccgtcctcttactaaggactatcttagggatccattttataagcaaccattgacttctatcagcctcttctttccttatcatcaatacctactgccattcacatccgccatccttgggagctggtcaaggtggaccaccacagtgctatatcatcatcggcagttccacaagcatttggtattagaggaaaggagaagaataagacagagctcagtccagtctgttccccttcattctttgaatatactatttcttctttctggaatatatcccctcccaaaccttccaactttggcagttcattgctctttcctcagtgtttccacaacactttgttctcattcgtgtcataactcatcatgtaaccacaatgatttgtctctatcatctccctaccgggactgtgagctgttcacctcaatggtgttaatacagtcttcagtctctttgatttccctgagactgtcaactccttctctctctctctttttttttagacagagtctcactctgttactgggctggagtgcggtggcgcaatctcagctctctgcaacctctgcctcccaggttcaagcgattctcaggcctcagcctcctcagtagctgggattacaggtgtgcaccactatgcctggctaatttttgtattttttgcagagacagggtttcaccatgttggccaggctggtctcaaactcctggactcatgtaatccgcctgctttggcctcccaaaatgctgggattacaggtgtgagtcaccacgcccagccaactccttccttttctttgaacctctcttcttctttccggtgatactccacaatcctgattcttcagtctttttggacaatctttagattcacttttggcttgacttttctcaggctctgaatatgtatgtctcaggatggaactcttggccttttgctctcttcaactctttgctttcagcttcaactaccgtatttacttgaaggtgtccaaaatatccattctccaccttcttcgagaactcattcccatacccatctcacagatcttgtggtcaccccagtttcagcaagtctaaaaccgagctccttgtcacctccttcaagccagttcctccacatgaggactccgtttctgtgaagatgctaccatccatctttctcgatttgccatcactccaaactcctttccctcttcttgtatgcccattgtctcttaaatctgtctcttttctcacccccatcctagaaaaaaatgggttctgaagtcaaatcgattcagctctatcacttatgaatcacgcaagtttggcaaacttattcagagtcttccacttctttatcctaaattaggggtaataatagcatctatttcatagggtttatctatgaagattaaatgagatatcgtggaggaaagtgcttagcccagtaactagtatgtattaggcactcaataaatgttaattattattgttatccttatttccttatacttagactattacactagtctcctaaccaatctctctgcctcctctggtcattattctctccactgggaggggaactaacatggaatatctattaagtgtcaagcacctcatgctgaaagcaatcttatacagtaatagtagcatcattttataaaaatggaacagagccaagatatgaacataggtctgacgctaaagcctgtgcccttttttcatctccaaattaccacgtaatcataaaatactattttcacacatcatcctgcttaaacacacacatacacacacacacaccacacacacacaacctttaatgaccaccctcccccattttccttcagaacacaacccaaatttattatcctagcattcactgtcttgtacaacttccctcacttcccaacactttcctataggaaccctgtgctccagagaaacttatctgccgcctcaggcacatcctgtacaccctcaacttcctccctgaaatgccctctcctctcccctcccctggtttaaatccagcctttccttcaggtcctagctagagtcccaccctcctccattacactttttcctaacttccccagcccctcatcaggtctccctcgacccctggagcagccgcctgtatccttgttgacacgtggtgtttgccattctgtttttctttgcgtttatgttttctcatcaagctgtaaacctctgcactccaggaaatcggccttctcttttttgtttttgtttttgggtgtttttttttttcctttcagcatcccaagtagcccagagccctacaaatagaaagcgcttgataaatatgggttgttttggatgaaagatgatcttcccagctggatgagctctttccctctaggggtgagggactgagcttcacctcaacttcacctaatgtctcacaggaatgccccctcttaaacgctcctcaggtcttctctacccctttcccccaccaccccggcccaggagagccactcagagctccctctccggagtcaccctctcagacccagggctatttctttagcttgctctcgaaccccgcctttaccccagagccgctcctcagtctcctcccccaggctgcctctcaggccccctctcctccaatgccactccctaggaccctctccccagggttccggacccccaaccccggatatgttcccccagggccatccagttgttctacctccaggattactgatttagcctcttccccctcctgctcagggctacccccagaccccgacctccagttccaccccttcggaccctgcctctagaactgttcttttagcctctgcaaccccctccccagcgccgctccgcggcccctgccccagggctggtcggggagccactgccctcgcaggtcccgcccgggtgctgcccccgcgcccccggccgccccccaccggggcggggcgcggcggcggcgggggcagggaaccgggcagcggtggcggtggcggtggcgcgggcggacgaggcggaggcgcccttcgccgggcaggtggggctggcgcgcggggccggggcgcgggctcggggcatccgggcagggcggggggcggcaccggggacgggcctgggccgggccgcacctactgccgaggtcgcggaggcggcgcgccgggggtccgcgccttgggtccgggctggcgcggcccagggcgggggctggggagggcctcgccgagggccgccgaggccgggagctgcttcagcaccgcggacaggggcagcgggcgggggccgagcacgagggtcgggtttgttgtgttggcagtggggtgtgtggcctgcatgactatgtgcgagggaaaccgtacaacgcctcggagtaaatagtaagcgcagccagtctgttgtgggttgggagaagaaaccgaggatgttcaagctggagaagggggagggggagggcggaggaaggactcgatcactgtcttcgtagctgaagggctgtcaggtggaggtaggatagacttgttctagcttggccccacagggcagaactagggccagcgggagtgggggttgcaagaagacaaatttgggctcgatataggaagaagtttgtaacaattggagctgctcaaccagcttaggaggcggcgagctgctcatcactggcatgtgcaagtaaaagctctcggaggggattggatggaggcatgcataatgcttgcatggatgcatacatcatcatcacaataatgccagctagcatttactgaacactcactatgtgccaggcctggtgctatgttttatacgaattatccaattcaatcctcataactactctatgaaatagctgcaattattatccccattttacagatggggatacagactcaaagagcttaagtaacttgcccaaggtcacacagctagtgagtgatggaattggaattctaacctaggcaggctgactctagtctccccttatttacccatgaccttatcctatatctcatggggggtgcagttggactaatttctctagtatcttccaacctagaggactgcaatattctaataaatgatgttgggacaatggtgttttgctgaggaaaatcagagtgatagcctcgccaccctaagagatggagtatatttgttgaagcaggcagtctgtttgtttagaagaatctgcctcaagagatattcttaattgggcatggagctcagggggtcatacgtgcactgaaattgcgtacaaatttgtaagtgcaaatgtgtgtatttctaggcgaggacccctagatttcttcagcctctcaaagggttacaggttccacaaaacaacaaaaaagatatggtgtgtaaaagaacctttagtgccagttggcagttgtcctccaaagattttataattgctggttgacttgttgtggaaactttgcttagcctctttgtgttttcacatgtgttttatcacatgttaaagtaatgcatttcctaagtttataccctagaagaaagattgctttagactgcctgagtgcacaggatgaggtggaaagaccctggcctgggattaaggaggcctgggctctgatctgaccttggcccccattggtttgtgtgaccttgagccatttccttgccctctctaggcttgaatttcaccatgtctaacataaagagatagagctagacaatctcaactctgaaacttttttattcctacaatatttcaagcattaagaggaagctagtccttacctgtatcagttttataggctttgattattccacctcttagcctttgtctttttaaacttaagtttccccctatgacacgagacccctagaatagccacactcattctctgggtcattttagttgtccttttctagataccttttggccctaattttcaatagatgtcaacttgaccattgtctccagatacaggaccctacggttttgcataaaggaaggttggtttcttctttgctctcctggtcccatcctgcttcccccttccctctgtcagctttcctgatctcaacacactaggccactgcctttagggaacaatctataatagctcccggagccttttcctgggtcaaaactgatagcctggaacacaacaccctgtatgtggattatttttatcggagtgcattaccttacatttctccaccttgacgtttgtctgccatcttgcattgcactcagtaacttccttcaagcattcgctcactctctctctcccttcctccacctcttcctccttccttctcttttggcatagcatttccctgtctgaaagggcttaatatgatctgaagtcttgaaattttcactttgctatatttcttctggatcacttataaaaaatttaagtgagacaggtcccagcatggtctcttggggccccctgcactcttaatcccctttcattcacggaagtgaccatttatatctatctattgttttctaagtgacaaaaacatcatccttaatttgacaatgactccattttaaatgtctaatacattgtccaaaacttcctgaaagatagacaaattatatccactgcttctctcaataatttgtgcctaattatcctttcactgaacactaggggatcacttgattgacaccttatagaaatattgttgcttttaagccggcagataatattgcttactcctctttctgtcttttaagccctctggagtctgtctccaccctacccctccattagcaggccatatttcccactgcttattgataacgcatccttactcgacaagctcatctctcctttacccttagacaggctgcccatatttctctggacattgtcacatagttacttctgcacccctacccgttcatttgaaacctttccttaaagtttcagctcaagccctgcttctccaataaactttccctgatttctctagttgtcattttcttctctcttctccaggaaacatttttaaggcagccccagccagtttgtcatttatttatttacttatttttatttattttatttatttatttttgagacagagtctcactctgttgcccaggctggagtgcagtggggtgatctcggctcactgcaacctccgcctcccaggttcaagcgattctcctgcctcagcctcctgagtaactgggattacaggcatgcaccaccacgcccggttaatttttgtatttttagtagagaagggttttcgccgtattggccaggctggtctcaaactcgtgacctcaagtgatccaccttcctcagcctcccaaagtgctgggattataggtgtgagccaccgtgcccagccctatttattttttaatagttaaacattatttttggggagaggaaggttggttcttaggcaaggctttcttgaccaaaatgttttatttttttacattgaacaaaatccctgattctcaatgctcatcattaagtattcaatgagcaatcaatgattctactctttatcctttatctcaaaaagttacatggatctgaaataggcactcatgggcatggggctccaagcccccttctaaaacccttcttagagatgggactcattgccaacttgtactttcttcggtagaaatcaagcctattccttttggcagtggttccacaagctcacccttgagttccttcagaactctttaggtagtcttctaatggtagtggcatcaatagaaagaaattgagagataaccgtgaccttagagatcacccagtacctactacagcacttactagatacttctttaattgagttgcccaagggcacagaacgtgatagtagatgattcggaactactgtagaacttttcctagttctcctgatttctaaattgaaagcatttttcatcatcattgatttttcatttcgtatctatgatctttcattaccaagccaaaaaatttttttattcagtctatcttctcctttgctttatttttctccacaccccacaacccccgaccccttgaagctcaacaaacaggatcctatgctttctttagtctttcttttttatcttacacatcaagaggtcccactgattctctaactggcttccttcatttgatttattaaaagcaccacttctcttatttgctgagtagaatgctcctcaaatacttttctggccttcctagtttccaacttgattctgaggaagatcagaacaggatgaaagagacaagtcaattatcacaggccacatgaataagtaacagagtgtgactcctagacccaggacttatggattcctgcccttgagactggttttgagtggtttgtgctgaggagatggagaacagtctttggtttgaaactgtagtcaaggaagattgaccccgaatgattggaggggtaagagagtgacctactaagaagcaccaacgtattcccaaatcaaaatattctttcactgtgatcatggcctccagtatatcttcattcttgtctggaaaaaaaaaactcactattaggaagttttcccttttacataagctggatctagtctactgtatttttaattcattttctcttatttttactgtggggtttcatattactttaatagctgtttatatttgtaaggtgctttgcacttcccatatgccatgtatgtggccctatttggtcctgggaacaataccatgaggtagataaggaagacattgtcctcattttataggtgagtaaaaggagactcaaagatgatgtgaattgcctatcatcttgtctaaggacccacacatagctcataaacattaaagcaggccaggcatggtggctcacacctgtaatcccagcactttgggaggccgaggcaggtggatcacctgaggtcaggagtttgagactagcctggccaacatggtgaaaccccatctctactaaaaatacaaaaattagctgagcctggtggtgcatgcctgtaatcccagctgctgaggcaggagaattgcttgaaccccgggggcagaggttgtagtgagccaagactgtgccacttcactccagcctgggcaaaagagtgaatctccgtctcagaagaaaaaaagaaattaaagcaaataacagaagctaggttttctgttcttgggctcagcactctgcccactatacaagtttcctgttctggattattattgtagccttttagccagtcttttctactttcaagtatgtcctactctggtccttgaaagaggtatttttagaactaataaaagtaaattataattgtacccaaaagactaatcttaggaaatgcctagccctatagtatggtattgtttgaactcaaaacaggaagaacaaaccacagccaatatctcctcagtacctagcacagtgcatgatacattctggacatgtgataaatattttaaaattaattttgttatctaatccccatcaacttctttgaatagtgcttggcacacaaaagtcgctaccttttgtgaagaataaatgaatgcatgctagaggtataacaaggtgccgggaagcaccgaagagggaggagatgaggttccccagttgaggttcgggaagccagagaatgcttcaggaagaaggtggtatctgagatgaacctttgagggaggagaatgatggagaagggtgagtggggcagtccaggcagaataaaaaatatgaaccatggctccacaaaaatgcatggcatgtttaggaaacagtggataatttgatgtgcctgaatcatcaagttacttgctgtttccagtaagagtgtataaggagaagaggctggagagggagactgagagcagattgtgcatttggcttttgtccaaaggctgaggggagtcattaaaggtttctgagcagaggagcgacctgctcagagccatgttgaggaagtggagggactggagtttgttcctgagttgttctggctgctggctcctgccctgaatgcttttaagctttcttagcacaacttaggggcgagtactcattttagggctcaagtgacccgcccaccttggcctcccaaagggcttacaggcatgagccctggccttgcctgttagcagtaatttaaagactcaattctatgccacaaacacttacgaggcataaagggcaccaaaagtacttggccagaaagtcaggagttgttctttactcctttctctctttatacatatgtatgtataaagatcatttgaggccaggagttcgagaccagcctggccaacatggtgaaaccctatctctattaaaaatacaaaaaaattagctatgcatggtggtacatgcctgtagttccagctacttgggtggctgaggcacaagaatcacttgaacctgggaggcggaggttacagtgagccaggattgaactactgtactccagccaaagcaagactctgtatcaaaaatcaatcaatgaatcaatcaatcagtccactcaggagtcagttatatctgaagcctatatggcaaaaactaatgtttgacaaagctggctggtgattttccaatatatattgttattttatgcctttctgaatgactgaaatattgaataataaaaaaaattaaaaacaaaccaaaatctgatcaccttactcccaccctcacctggcttaaaatgactcttaggacaaagattatactattattactgtactactatcacttcttccttttagttttattatggaaaactttcaaatgcatatgaaaatggaaagaacaatattataaactcccttggacgcagcacccacaaggatcacttgagtccgggagtttgagaccagcctgtgcaacatggcaaaaccccatctctacaaaaaaatacaaagagtagctgggtgtggtggcatgtgcctgtagtcacagctacttgggaggctgaggcaggaggattgcttgagcccaggaagctgaggctacagtggacagagatcacaccactgcactcaagcctgggccacagcgcaaaaccctgtctaaaacaaaaacaaaaacatgcttaatgaagccgatgaggccctgcatgactgagtccttcccatctctctgacttccttttataccacccattctccccattggtcactagactccagtcaccctgcccttccctctctttttctaatatacaggctccttcccattcaggaattcagtaaggtactctttcctggagtctcattctcagccttcacctagcctcttctgttcattcacagatgtcagctgagatgtcatgtactcagggaggccatccctgatatcacagcctatatctcctgccacacacttttgtagctcctggttcttctctttcattccacttatcaccactgtaatgaaatgtttagtatttccatgtctatctctcccaccggctgtaacttccatgaggatgagttcaaaggggactacaggcatgtaaaccattatttataatgtaatacaaaatatgctataaatgaggatacatataatgccattgggagcacatagaaagtccatttaaccccagacagatagccctccctgatgaagtggcattcaagttgcattttgaagtagcgcaccatggggaggccagagtacatatgggaaaggagttctagggagagggaatgaaataaaggcacagaggcaggactctgcaggatatgctcaggcaacacaattaggtcagtatagctagaggttggggtacttgaggtgagcaataaagggtagaaggtacaggacagaacatgaggctggcagaaccaggcatggtggctcatgcctgtaatcccagcttctcaggaggctgaggctggaggattgcttgagaccaagagtttgaggtcatagtgagctatgattgtgccactgcactccagcctgagcgacagagcagaaccccatctctacaaaagaaaacagggctggaaaggtgcattggcatcacattgtaagggttgttgtgtcatgctaaagaatctggactttaagactggcaatgaggaaccagaagatcggcttcacagtcaatccacttaggctaaaataatggaactttttaacatgacttacaggttatttagttcaaccatctccctgttgcagttaagaaactgagacttggtctggctgtggggctcacatctgtaaccctagcactttgggaggccaagctgggaggatcacttgagcccaggagtttgagaccagcctgggcaacatggcgaaaccctatctctacaaaaaatacaaagattagctgtgtatggtggcatacacctacagtcacagctacttgggagactgaggcaggaggattgcttgagcccaagaagttgaggctacagagagcagagattgtaccactgcactgcagcctgggccatagagtgaaaccctgtcttaaaaaaattaggccaggtgcagtggctcacacttgtaatcccagcactttgggaggctgaggtgggtggatcacctgaggtcagaagttcgagatcagcctggccaatagggtgaaaccctgtctttactaaaaaatacaaagaattagctgagcgtggtggtgggcacctgtaatcccagctacttaggaggctgaggcaggagaatcacttgaacccgagaggcggaggttgcagtgagccaaaatcacgccattgcactccagcctgggtgacaagagcaagactatgtctcaaaaaaaaattttttttaatttaaattttaaaaaccctgaggcctggccactggtctttgtcttcacttttcccttttcttaactcaccaagaagtcgagcctcaggggacagaaaattagcagatctgcgggagggccttggacagggtgaggaagactaaggcctctccttttccagagagtgaatgagaccatggccacactcctgactgtgggcagaggcctccccagaactgcaaaacttggacatcccagtgctgacccaaaaccccaaatgtgccacctccccgggtatggtgatcatctggcttgtggtggcctcctgggagtgggccaaggacattctgcagagcgccagggaattcccgctagtgcacttaccacccactcaagagccgatggcagccaacaggcaatgctgcgccattaaggtgtttgtcaagaagctaagctgggcattgtgggcgatcctgagggccctttttagattggctgtaagtgaagaaaaaaaacagcatttggaggcaaactagagctagtgcagagggtgtagcatgacagaaaaccctctgagaggcagagatgcttgcctccatgtctggcttccttaccaacttgctctgtgattttgaataagtcatttcccctcccggagttttctttctctcttctgcaaaacaagtatgttaaattagatgatctctgagtattggtgaccagtgcattttctagatacctgaatgattatgccttcagtatgaaattttacgaattagttatataactcaggtgggctcagcagcaaggctgggacctcagttatatgggtagaggaggaagcagggttttggtgggacaagaagtggagggaactgacacagtgataggacccatccctgaggagtcaccagaaagacccagtgatttggtctggcagcaataaccaaacgtggtggtcaaagaggagaaatgacttattaaaaatcaccaagggctgggtgaggtggctcacacctgtaatcccagcactttgggaggctgaggtgagtggaccacctaagatcaggagttcgagaccagcctgactaacatggtgaaaccctgtctctactaaaaatacaaaaattagccgggcatggtggcgtgcacctgtaattccaactactcgggaggctgaggcaggagaatcacttgaacccaggaggcagaggttgcagtgagccaagatcgcaccactgcactccagcctgtgcgacagagcgagacaccatctcaaaaaaaaaaaaaaaaaaaaaatcactaagagcaagttggtgggggagctgggaatggagccaagcgtctctgcctttcagcggttctttccaaggagtatgggagcaggaatagacaataacattgtacgaacacttactatgtgccagaatctgctaaatgcttcttgctgctgtaacaaattaccacaaacttatttctaaaagcaacacagacttgttttcttacatttctggaggtcagaagtccaaaatgggtcttgctggactgaaatcaagttattggcagggctgcattcctgctggagtttctaggagaggatctcttccttgccttttccagtgtctagagaatgcccgcatcccttggcttgtggccccttctagcagcagcagcactgctataacctatgtctcccaacaccttctctgactcaaaccccctgccttcctcttataaggatgcttgtgatttcattagacccacctggataatccgggctaatctcccccatctgaagatccttaacttaatcatttctataaagtctcttttaccacataaggcaacatattcccaggttttggggattaggatgtggctgtctttgaagggtcattattttacctaccacagtgcatcatctcactgagtcctcctaacagcccttctttaaacatctgtttaacagatgaggaatgtgatgcttagaggagttaggtcatttgcccaagggcactctgctggaaagagaaaagttaggtaatatttggtatgtggtggcatcttggtcccaagtgagctgtctttttagataggaccccattcagctcccaagtgtattgagaatacagtctaactctgtggaggaggctgtctaagaactaggcagggaatctgagaccctgaaaaatagattagggtcacagcagtctcagcttagaacttgaatgctagagagagaaactgagggaaaaaacccagttgtaagcattaagccaatatagcaatggatgaggaagaatgatcttaggccaccattcatgcctgcatacagtgatacaataatatcttagtgttgggggttgaagctgctgatggaccatttgctcaagttaggattgaccaaggagatggacaaggtgagggactcagagataactgcagagccgaggcacagagagcagaggctggctactgagccagtgctaatagaagacttttctaaatgggtaacatagtcaattataagtgacactgaacaacatgtccatttcgtcatggttatggcaggccctgtgctagctgttggggtgacaatgatgaggaggacatatatgcattttagagtcaggaggaagcgacagatatttcaacatgtggttacaatacagtgtggtaagaattgcgataaggaaacagatgggggactgacagggatgtacaaggaccttctgaaatagatgtaagaggccaaggctccccaaagagggaggaggggagagtgaactgaatagaaggaacaatacgtgtaagggcctgggagaactggaactcactggaacacagagcactaggtggggaaagataaaaggggttgcagagggagtcagggaccatatcataaaggctcttaactgcagagatggaaagctcttagagccacctcagggcattcacacttactgttccctcatcctggaacacgctttcctagtagccacagggtccactccctcacctccttcagatctcttgctcaaatgtcacctgctcaaagagattgtccctgatcaccctccataaatagctgtcccactctccatctctccaaccggctctattcttcacagcacttattcccacatggttcttccactagaccataactactagaaagtaactagaatgctgtttttggtttttgtttttgtttctgttttagacatggtctcattctgtcgcccacagcccactgcagcctccaactcctgggctcaaggatcttcctgccacagtctccagagcagctaggactacaggggtgtgtcaccacgcctggctacttttttcaatttttttttttttttttagacagagtcttgctctgtcgccaggctggggtgcagtgccgtgatcttggctcactgcaacctccacctcctggggtcaagcgattctcctgcctcagcctcccgagtagctaggattacaggcgcacgcccggctaatttttgtatttttagtagagatggggtttcaccgtgttggccaggatggtctcgatctcttgacctcatgatctgtctgcctcggcctctcaaagtgctgagattacaggcatgagccaccacgcctggctgtttttcaatttttttctttttttgtagagaggtgtcttgctatgttggccaggctgggactagaatgtttttgtttgctcttttagccctagcacacagtacttggtacatagtaggtcctcaataaatatttattgaatgaagggacagaaataaacatttgatgtttaggaggtaggacccatagttctttggtaaaagactagtgtgctgtggctcacgcctgtaatcccagcactttatgaggccaaggcagatgtatcacttgagcctaggagttcaagaccagccctagcaacacagcgagacttcgtctccacaaaagattaaaaaagaaaaattagccaggcgtggtggcaaacgcctgtagtcccagctactcaggaggctgaggtgggaggatcacttgagcccagaagttcaaggctgcagtgagccatggctgagagcgagaccctgtctcaaaaaaaaaccaaccaaacaaacaaacaaaaaaggaaactggatgtaggcagtgaaggagagggaagagtcacaggtcatatgaggctgctggtttggacaactgggtagctgatggtgccataccctgacatagcacaggcatattgagctcactattgtctgagataaggcattgcactccaggagtgtgaggtataggaagtcctgggagggggaagggctgcctgtccaacactctgaccgtacggaatatgcctgaattctgccatttcttagctttagggctctggatacttgtaggcactgccagagctctgcctcttgccacccccattgccacttctaacctcaccaccacctctgctgtctcccgctctcttccctcttctgtgcacattttgttctccttggtattctctgctctctcctttcactgccaccactccgggacttctcagctttggcttctcaggaacccaaatcctgccttctggccggcagaccagtcacaccatattgtctatgatctctacgtctttggctcagcccagctattttggtctctgcttgcactctgagatttttcttactttcctctgggtttacacctctttctgcacttaaagggtgacagacatcttaagagttggttaactgagctgtaaaggttagacttctgacgtggctgatgattgattaatggatctaggtgtaaagagatgaaagcaaggtcattctgtctaaaagtgaatgggacttttttccttcagtgggttttatcttttttttcaaatggaacaatggaacctattgcctcatcaagcaaggaagtcaaatcacaatagattgaatttcagcaagtgttttttgaaacctctaatagataccaggaattgtgcttggtgctttcagtgtattactaaatcttcccaagatgaagtcccttccttgatatccaggcagtgcctcctagatcaactgttcattcattaactcagtgattatttcttgtgtcagacactgtgctaaatactataacagatacaaaaataaatatgacaccatctctgttctccaggaactcaatctagtgggaaaaacagacatatccatgactgggtatgatacattgtggtagctgtgtgtacaaagtactgcaggagtaaagagggcacccactagctctgacagggagagctaaggaagatttaacaaaggaggtgacattgagctagaccttgaaggatgagtaggagtttgctaatgtgcataaagagaatgggttttggaggcagcagaaacagcctggaactgtgaagggcagagagtgctttggacttgctatgactggaatgtagaacacttgctctagcctcaggagttctgcccagagaaggcagaggattgtctgggtcacagagaaagtgagtggcagagacaggattaagcagcatgaattagaattgtccgaccccgatccatcttccttagcctctaatacacacacacagacacacagacacacacacacataatgctagtccaacttcttgtcctgtcccctggcttagatgctgtcattcgactgcccccaccccatttgcccttctaggagtgtgcccctaggctctgaggattgtccccagagaacctgggagagaaacagagcctagagaatattagagaatacactaatactggcccacccccaccatgtgtctgatccatcccagtgtttagttctggcctagacatttgcctatgacctgagtccatagatcctaactcctgatgtggccacgatagactctgtgatgttcgtaatggatttggatgggctgtgagatgctccttgcttgagtatcccagaaaacgagctgcgtaaaccaggttgccagctttttactgaggaggagctacttttaattcccagagcactggaacgctagagtgggcttatgtagaagaccccctgttcctcacttcctaccataagcaggaatgaaaatttttaaattccatgctagcttcgaggtggatgctcaaaaaatactccattggctgactggcttgtgagtagttatctgttcagaggtccctagctatttcccaaatggtgtaattcatcttagtcaaatttttagagaaccagtagagtccgttggcagatagggaggcactggatatattttaggtttgtaccacacctcttttggggatgtcttgaggcagcttacatattaaaacataatgtcttgtggctctacgcctgtaatcccagcacttacggaggccaaggcgggtggatcacctgagcccaggagttcaagaccagcctggccaaaatggtgaaaccccgtccctactaaaaatacaaaaattacctgggcatggtggcacatgcctgtaatcccagctacttgggaggctgagacaggagaattgcttgaacctgggaggcagagattgcagtgagccgagatcgtaccactgcactccagcctgggcaacagagtgagactccatctcaaaaaataaaataaaataaaaattaaatttaaaaaaagcccataatgtctttatgtaagtcttttaaggatgaaacataaaacttggtggtctgaaggatgaaaaaagtaatggttacttccaaacatccccatgctcaacaaataagctataaatttggctgaaaaattcctgggagaaagacaaaaagggaaacgcattgggttatccagtgttccttttcttataccttaaagtatacagaatatcctatagggaaaacattttcctcaagctaaagcctaatagaaagtaattgtgtttggtcctaagaaagttgagtgagaaggtgaagggtatgtaattccatttagccgtcgtttctccgtatccactcagcaccaggccctatgcagtgtccccagtcttctgggagatgctgtcatgtccataagtcacccaagagaaagaagacttgaccgcaaaagatgaactgccctccataggacccacaagaactggctcttggtccaaggagcacatgggagggcaggatggctagatttcaaaaagcaagagtcaaatggccaggcacggtggctcatgcctgtaatcccagcactttgggaggccaaggcaggtgtatcacttgaggtcaggagttcaagaccagcctggccaacatggtgaaaccccatctctactaaaaatacaaaaattagccaggcagtagtggcatgtgcctgtaatcccagctacttgggaggctgaggcagaagaatcacttgaacctcgggggtgaaggttgcagtgagccgagatcacaccactgcactccagcctgggcaagagagcaagacttcatctcaaaaaaagaaaaaaaaaatctgctcagaatgtgctatgctctcccacatttccaggcaattgcacatgctgtatacttcaaggcttagcttaaatctcatctctatctggaagccgtccctgagttcccctttctctgtggtgctctgctccccaccatggataagacacccttcttttgttctcccatagaactctatgcacacttgctttttagcattgtatttttattgtgggtttacttgtcagtctctgagttccttattcatctttattttttcagagcctcgcacagtgcctagcctgtagtaggtgctcagttaatgcttgttgaatgcacataatgagcaactactgtatccagcactgtcctgggcactggatgattaagctacagccccttccctcgaggatgttaaagtcccagcactttgggaggaggagaaggaggaggaggaggaggagactcttacataatgattccagcccaatcttataatatctataataggggatttggggagcacagaagaggaagaaaataacttagcctgacacgtcaggaaagtcttccagaggtagtaatttatgggctgaaccttaaaatataatttgttttttgccaaactgagaaaaatattaggcagaggaaaaaacatgtattaatacaaaggcaggaaagagaatcaatatttagggaactgcaagtattgatattctgtgccatcatttggaatggaaagtatgtttcagatccaattgtgagagacagaaagttgttactttattgtgtatgtttcaaggctttattattccaacaatttttcttgtatcatcagatggattttatcacaaggcagtaaagatgttatagtcacctttggtgaagcaaataataacttatttatagtttctggctggctgccttctgaaaaactgtttcatttgacttataataaaagacacatccataattagcctgttcatatagacacatgaaacaaaagctatagctaggaggggaataatgccatttccccaggctcttttcccttcattggcttacttggcattcaggataatcctctgaggatgggaaacagggttatctagattcgagcccagcatgtagctcctggaagtgcttgtgggctcaacaaatacacggatgttttcctcattttccagctgatgccacacatatttcctggtactcttgtgtccctgggtctccatcccctcatgcttttgggtgggaataatttttttgtttgttttttgagacagagttttgctcttgttgccccagctcgagtgtaatggcgtgatctcagctcactgcaacctccgcctcctgggttcaagtgattctcctgcctcagcctcccgagtagctgagattacaggcacccgtcaccatgcccggctaatttttgtattttagtagagacggggtttcaccatgttggtcaggctggtctcgaactcctgacctcaggtgatccacccaccttggccttccaaagtgctgagattacaggcatgagccaccgcgcccagccgggaataatctttacttgctatccttcagagtcattacttgttggagctccttcacccaagcttctttcagattctcttgcctttttaatgtttttctcctctttaaaaaaatcactccatgcataaaacttagaaaacaggaaagcacagaaaagaagtgcctcgtgatactataaccaaaggatactcagtcaattcttttttatttaaaaaaaaaagttatgacatcatttcagactttcagaaacattttcgagaataggacaatttctttaaatatttatttatttacttatttattttagagatgagatctcactctgtggcccagcctggagtacagtggcatgatcatgtctcactacagcctcttactcccgggctcaagcgatcctcctgcctcagcctcccaagtagctaggaccatgggtgcacaccagcatgcacagctaatgtttaacttttttgtagagatggggtcttgatatgtggcccaggctggtctcaaactcttggcttcaagccatcctttcacctcagcctcttaaagcactgggattacaggcatgagccaccacacccagccaataaagaattcttgaatgctcctcacccaaaactgttaacatctaactatacttactttatctctctctcttctctctgtctctgtctgtctctctctttatatatataggcatatatgtatatttcttttttttttttaagacagagtcttgctctgtcacccaggctggagggcagttgtgcaatcttggctcagtgcagcctctgcctcccaggtccgagtgattctcctgccttagcctcctgagtagctgggattacaggtgtgcaccaccacgactggctaatttttgtatttttagtagagacgaggtttcatcatattggccaagctggtctcgaactcctgacctcaagtgatcctcccgcctaggcctcccaaagtgctgggattttaggcgcgaaccaccacgcctggccatatatgtatatttctgaacccatttaagaataatttgctagccaattgtcacctgggccaaaaaaaaaaaaaaaagaataagttgcagatattatgcacccttatgtcagcctcagtccttcagtgtgtatttcctaaaaatcacatattctcctacatattaatttttatatatgcctttctagattttttctatgcacacatgatttatttatatttaaataagatcatgcattgttttatttatatttatttatagtgccttgcttttttggggggtagcaatacatattgtatataatctcctgccaataaatattctacaacatgattcttcatcaggctttgacagcagacacggtggatttctgggtggcacaacattttcaaaataccactctgcatcacggaatcagccgtgctggccgggcgcggtggctcacgcctgtaatcccacaactttgggaggctgaggcgggcggatcatgaggtcaggagatcgagaccatcctgggtaacatagtgaaaccctgtctctactaaaaaaaaaaaaaaaaatacaaaaaattttacaaaaattagctaggcatggtggcgtgtgcctgtaatcccagctattcgggaggctgaggcaggagaatcacttgaaccccggaggcggaggttgcagtgagctgagattgtgtcactgcactccagcctggcgacaaagctggactccgtctcaaaaaataaaaaagaattaaccatgctgtgcttttccaggtctagtccaatatcagtggaaagcactgaataaatgagtaaagaggcagggcaatggaaaactctgaattcaaatttaatctttattctgtggccagtagaaatccaatgaaatgtttctagcaggaggggacaccaataaaagctgctctctggagatgaatttgacagtgtctgcaggatggggtgaaggaaaaagaactcagagcatgagtccaggagtcactggggtcaaatgatccctcgtgttcaaggcacatctctgcccaggtagaacagagcctttcccagcataacgcatctttttctttcccgtgtctttcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtaagatttccataggacattgtgcctttgaactttctggacttacatttgggttcacatttgtcatggcctgtgtacaccccatgcccatcctcccttcctatcttttattcctgcagtgccatcctgggaaagaatatctcgatgtgagttgggggtgtgctgggatgggagtccagccctcccattaacattccatgtgaccttggagacaagttgcttaacccttctggacctcagtttccttatcagtacagtgaggggttgggttatagatggggtcttaaatcccctctggctcgaataatttatctatgggtcaccctctggagttccctgcaacgtgcatgtctcacagaatacagaaaacgcttgaatgataatgagttggctccactttttccatttaccaaacatgtgctgggtgcctgcatgtgcctgtcatccggccctccagaggctcaccatttagtgacaaatacagtcatctagccacaccagtctagagctcagaaggaaacaatgagttttggggagacacttaggaggtagtaacacttaggaggtagaaaaaagccatgaggatggtcccaatcactcaaggagaatgtaaagattcacgggcagggtgctggggatggaaccccacaaagccagccgagaaggggcagccggagggcaagaagcctgacgtgatgatgtgatgcaatgtcatgatgccacatggtgtggggtggtcagtggggccagccactccagagccctccaacaggagcatggctgaaagttgtctgctgggtttagtgacaaagagcttgttgttaacctcagcagaatggtggagatgaagtcagactgaagtggggagaagcggaggtgaggagaagaggtggcaagtggagggaagacattcaagaagcttgacagggaggtggggagaaatgggtagcagctagaggatgaagttttgtttgtctaagataggagagagttgaacagccttaaacttgcttaagaaagctatgagagttgtttaagaaaagccattcacatcattaaagcatggaaaagaacaggagtgagtttcctaaggaggtgggaagggaggggaacctgaggcaggtggaagatgctagcagggctgggtgaggatccaagggagttggtggggggaggaacaggaaatgcacccagttgtggatcaaggatcaatttgacgtaagtcactcctggacagaatcatctctctgggtctcagtgtgttcatttgcaaaggagggtgttggattatggctctaaattctagattcccccccccttttttttttttttgatgagatgaagtctcgatctgtcacccaggctggagggcagtggcgtgatctcggttcactgcaaccactgcctccagggttcaagcgattctcctgcctcagcctcccaagtagctaagattacaggcatgtaccaccatgctggctaattttttttgtatttttagtagagatggggtttcaccatgttggccaggctggtctcgaactcctgacctcaggtgatcggcccacctcggcctcccagagtgctaggattacaggcgtgagccaccgtgcccagcctagattccattattttaagcatctaagcttttaaaacttggcaagtctggggttttaggatcctaaaatcctgtgtgaacatttcccattcctaggattctctgattatgagtgtgaacttcttctcctgtgctgttgtgaatacagtggactccttggccccgtggtctccagagtgggctggttaaagagagcccagccgcctttcaaagcggaggttattttgagggctttgcacaggcctcatggcagtgcatcctggggcagaagcactggtgtctctgctgcggcaccacctggccttgggttttactctgttccaaaaagccccaggcctgttggatggcgctcagagagtggcaggtggatggtgaaaggaggaggcagcgggaatgatccgagggaaaaggatggcatttcccacttgcagttctgcccacacctccttgtagaaggcgggggagttgtggtctggaagcaggggaaggaggaagccagttgcacttattaatccaagacctgagatggggagtgttcagggtagaatttagagccccaagatgcagctccagctctgtgaccttgggcaatggctgcctttctctgagcctgtttcctcccctaggtgcctttgggtctaactcagtcagaggtggttcttggttcccttcccagggactgttaattaaaggaagctagattagccatttaaagtcctatgtttgagtgtcgccttgggaaatgtcacacatttattcattcactcattcatttggtcaacaacatagttcctctagctcagctttgtgctaagcactgacaggaaaaaataaaagctccaggctttgttaaattgcattaatgaatagttcattttttcattcaactaagttccagtcctgccttgctgatttctgtgttttgcaaggtactggatttatctgtggattgtttccctcatctgtgaaatgggaataataatttcttttttttttttttgagacggagtctcgctctgtcgcccaggttggagtgcagtggcgggatctcggctcactgcaagctccacctcctgggttcaagccattctcctgcctcagcctcccaagtagctgggactacaggggcccgccaccacgcccggctaattttttttttttattttttagtacagacggggtttcaccatgttagccaggatggtctcgatctcctgacctcgtgatccgcccgcctcggcctcccaaagtgctgggattacaggtgtgagccaccgtgcctggcccgggaataataatttctgttacctcacagtgttgttttgagaatcaaacttttttattttatttatttatttatctatttattgagacaaggtctgactcccctcacccaagtgtactggtgtgatcttggctcactgtagcctcaactttccaagctcaggtgatcctcccacctcagcctccctagtagctgggactacaggcacatgccaccatgcctggctaattttttgtatctttagtagagatagggttttgccatgttgcccaggctggtcacaatcttctaggctcaagcaatctcctgcctcagcttcccaaagtgctaggattataggtgttagctactgcacctggccaagaattaaacattttaaaagaatgtgctgggcgcagtggctcatgtctgtagtcccagcactttgggaggccaaggtgggcagatcacctgaggctaggagttcaagaccagcttggccaacatagtgaaaccctgtctgtactaaaagtacaaaaattagccaagcgtggtggtgcgcgcctgtaatcccagctactactcaggaggttgaggcaggagaattgcttgaacttgggaggcagaggttgcagtgagctgagatggcaccactacactccagcctgggcaacagagcgagactctgtctcaaaaaaaaaaaaagaaagaaagaaagagaaatacctgaaactgggtaatttataaagaaaagaggtttagttggctcagggttccacaggctttacaggaagcatggctggggacgcctcaggaaactttcaatcgtagtagaaggcaaaggggaaacaagcacatcatcatatggcaggagcagggggaagagtgagaagggggaggtgctccacaccattaaacaaccagatctcatgagaactcactcactatcagcagaacagcaagggggaagtctgcctgcatggcccaatcacctcccaccaggccccgcctccaacagagacacaaatcaaaacatatcacctggtaacaaacagatatcaggatttacgtaatttcaggcactgggctaccttcttttgaggatacaatgatgaataggacatagttcctgtcctcaatttaccatttattagaggaaataaaccaataaattttaaatcacaacacaatataataagtgctgcagagaattatgttccacatcccacagttgttaagccacttcttttttttttttttttcctgaaacggcatttcactcttcttgcccaggctggagcacaatggcacaatcttggttcactgcaacctccgcctcacgggttcaagcaagtcccctgcctcggcctgctgagtagctgggattacaagtgtgaaccactgcagctggctaatttttttttttgtatttttagtacagatggggtttcaccgtgttggccaggctggtctcgaactcctgacctcagataatccacccgcctcagcctcccaaagtgctgggattacaggcgtgagccaccgtgcccagctgaagagtttgaattttattctcagtgtttggggaagtcgctggaggcttttaaccagggcatcctgtaatctcattgcatttacagagcattttcacatgtacttcctccttgaagacgcacctccacctaagaccaagaactagagttctcatgttgcagaggaggaaactgaggttcatattggttcagccacttgcctgggggtcctatgactagtggtggagctggagcttatcaagcccatatattctgattctcagtctttatacagctatttcctcatctatgattgtgagtgcatgaattaatgaatcaatcaatcatgttcttgttggggtccatccaagccagggtcccagagtgtagcttgaggatgcacattgctttccagactggagctggggaataggcagtcccttcctaaagtgttcagtgaccacagtgcatatgcgtgtgtgtgtgtcctctctctgcccaggtggatgaagaaaccccgatgtggtgtccctgatcacccccacttaagccgtaggcggagaaacaagcgctatgccctgactggacagaagtggaggcaaaaacacatcacctacaggtgcttcgactctccctcttcctccctgcctttggctccaccctcactctgtttttcctggcctgagtttcaaaggctcacaatgtaggggggcctggggatcaggcttacaacataggccaagagccaggcatgtgggcattggcactaggtgctgagagcccataaccttgtcctccttgtggcttccacaggatgctgtgactccaacctcaggtttatttggtcctctgggggctcttagttgtcttctgtttagatgcctatagtttttaggttacaggaagtggggtatgaatggtttggtaactttcagctgtgaaaaagaatcgtggcttgcagtgagctatatcatgccactgcactccagcctgcgtgacagagtgagactctgtctccaaaacaaaacaaatgaaacaaaaaccacaaaacaaaacaaacaaaaccatggcttaattcagtctccttatcactgcctgccaaaccccattccctctgatctggatcctcccaccccaaaatccacctgatggacttcacctgagattcccaacgcagagttccagttgtttcttaaggagtataaagaactgggacctgaatcataatagtgtcatctttgactgtctggaggaaccaagggcagagcaggatccatctccaagtcagatcagtggcccaagaactagatgatggagcccatcacagcagactgaagcaccggagtgaggctggggcaagggccaggcattgagcaggctcaggtgggggtggggcaaggggcaggcactggacaggctcaggtggggctggggcaagggccaggcatgggcaggctcaggtggggctggggcaagggccaggcatgggcaggctcaggtggggctggggcaagggcccggcatgggcaggctcaggtggggctggggcaagggccaggcatgggcaggctcaggtggggctggggcaagggccaggcatgggcaggctcaggtggggctggggcaagggccaggcatgggcaggctcaggtggggctggggcaagggccaggcatgggcaggctcaggtggggctggggcaagggccaggcatgggcaggctcgggtgggtgctggctggcacttctcaaggctctgctgtcatctcaggtggatccctttggtgcagaggcaagatctaagacagagatcctcaagagttgaactaagggctcccctgctgacaagcactccctacagaacgggactttttttttttttttttttttttcagaaatctgacaagagaaggaaagttagggttgaactaagggctcttctgctgataagctgtcccttcagaacgggattttttttttccagaaatctgacaagagaaggaaacttaagaatctaggttagaaactgaatagactcttgggtctcttgaaggggtagagtggatcaagagaaagaagcactgggttctaacccaactctgagtaacttctatcactagacttctctgggcttcagtttccttacgtgtggagtaggtagaataatccatgccccagagggtcacagggcagggaacccacaggtagtaacgttgttttgtgaagaaccaatgcaatatgaacacagcgacgctaaacagctaaacctataatggattaaatcagataccggccagcttctaggcagacaagccaaagattggtaccaaagattttttaaagagacttttcacttaaactcctctctattatttgaatatttttataacttttataaatgaacatatttcgtattagggaaaaaaacttaaaattcagaaaatgctatctaccaatttcctttgggttttttttttttttttttgagacagagtctcactcttgttacccaggctggagtgcagtggtgcaatcttggctcactgcaacctctgcctccgggttcaagcaattatcctgcttcagcctcccgagtagctgggattacagactcacaccaccacgcctggctaatttttgtacttttagtagagacagggtttcaccatgttggtcaggctggtctcgaactcctgacctcatgtggtccgccagcctcggcctcccaaagtgctgggattacaggcgtgaaccgctgcgcccagccccaatttacttttctcaacaaactagagtggaatcctttattcgacacagctttgctggagatcaaatggaaaacactgagtaaagcaaagccatctgactgaggcagggtggggatccagagctctgttactcagcctcttcttcaatccctgaggcagctaagcagaattctagggttcaaaatcagatcactgagccacattgtctcaggtatctattttagctctgctagtctctgactctctgatcttgcctaatgatcctcccctctctcaccagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacggtaaggccatgaggggacaggggtcagtcttgggctgctcagttgttgggaaagaacttggaggacatcctagatgagtttcctgctttctagagcctcttgtccaagaactaagaccgtaagagggtgggaactgtgatttctgataatattcaacgttcaatccaccagggccagggccatggagatgagtcagatcacttagaagatagtccggttggcaggagaaaagtaaggttaggccagtaagaagataaagtaatggaccagaggctgaagaaaaagtttaaaaggggccaggcacaatggctcacgcctgtaatcccagtactttgggaggccaaggcaggtggatcacctgaggtcaggagttcaagaccagcctggccaacatggtgaaaccctgtctccactaaaaatacaaaaattatctgggcgtggtggcgggtgcctgtaatcccagctactcaggaggctgaggcatgagaatcgcttgaacccagaaggcagaggttgcagtgagccgagatcgcaccattgtactccagcccaggcgacaagagtgaaactccatctcaaaaaaaaaaaaagttaaaaggcattaaagctgaaagaggggtctgaaagtagtaggctctggcctgaatgatgagggctccaaaagccatcttatgaatgacacgactggctctctcctttgtcaccctcacaggtgagtagcaggccctgaaattattctggcatccttggataatttaccctgcaccactatggttcaatgaatatttatggaggcagagtcaataccgtgcagcaatagtaatgataccctgcaggttgccaaaaaattcatcatcaatatttactcacaaggcacatgcttagtatgtaggcaagtgtacattattacacccatttttaagatgaagagttggggctcaactggcatagctgaaaggtgacaatgcaggtatcaagccctggttcaactactggctatgtgataccctcggtctcctcgtctgcaaagtgaggggctggattaggtgatcgctaagggcccttccaactctaatgaacatgatacaaagtcttgcaaagaccagggggagctgaatgtttgaaaaaaatggcatgatctctgtcccctggcagtccagagtcagtctagcaggggagttaggtgtgcacgtaagtaaccctgtcatagacagactctacccaaggctgtagcagaggcacaaagaaatatgtaggagtttggaggaaagagggacagaggagtgtggcttttggattataagagatgataattagtgggtatgctggtgttctgaggcccgtgccaagtgcttgccacccattatgtgtggaaactattatatctattaatacattataatgcataattaaatttatgtattaagcaatatataatgttaaattattattataggtaaatattgctatcttcattttacagataggtaaactgagatatagagaaacattaagtcacctacctaaggtcccacagttggtgaatggtgaaataaggctttgaatctgggcattatggccctggagcccatgctgtcagccatcatgctaagcttccatggttctcaaactgtagggcacagcagaatcacctgggaaccatttttaagaattcagattccaggccaggcacggtggatcacacctgtaatcccagcactttgggaggccgaggcaggtggatcacctgaggtcgggagttcaagaccagcctggccaacatggtgaaacccatctctacgaaaaacacaaaaattagccaggcatgttggcaggtgcctgtaatcctagctactctggaggctgaggcaggagaatcccttgaacccgggaggcggaggttacagtgagccgagatcatgccactgcactccagcctgggcaacagagattccgtctcaaaaaaaaaaaaaaaaaaaaaaaaaagactgcagattccaggaccctaacctcttgtcattctgattctctgggtccggggtagggcctgggaatctgcaagtggtctaatacattcctggggccttctgatgcaggtgttccatcaccatgagaaacgctatcttaatacctagagttttcctacctggcctgatcataagaaccaatgggggttcttgttataaacggggattcccaggcccttcccacagaaatcctgactcttgagctcaaacaagcttgggaaacaccgagcatccttttttcctgccctgcggctgctccaggctgagagcagactctcaaagctggtttggtgtctatagttggggccatgtttggtgtctatagttggggatcacctccttgagaacactttatatcatcgcatggattagggattggcagctctggggttatctgtcaaaggctggaccaggaggtggtttggccaaggctcagcctaggcaaagtcatgaacctgttaaattgttctttgtcctcttctttcttcagatttttgtcctctttcctattgaactccgtttcctttgccctggtatctctcccgtatgtcctgcatgtattcctggctgagtacctgttctttatctcattcttatttttggatcggtgtcaacgaatggctgtctgtgctaacagataagatgtgaggagaagagaactaatatttttgaggccctgttatgtgccaggcactgttagctgatagggttttagttatattcctgatagaggcaaatgaatgtccaaagagttgtccagaggcaacgggaagacactcccactcctctgccctccccttctgcccagcactgggggtgtgcacttcccacacctgctccttgcttttgcagaacttgttggacccagcccccaaatcccaagagccggtggtatgtgtgggaaggaccggggacctgtggatgggcaccatcccagcacctctcccatctgtccaaccctaaccttcatgaaagactgccaattctgatagaaattccaagattgctaatgttttctttggataagaatcaggactttgctctgctctggaaaaccaagcaggaactgtccagatgcagctcaggaccacagcaatcgactcctgaactggaatgcagtgaaggcaggttttgggtgagaggcaaggaaccaaaatttattgagcatccatatattatctcgtttaatttccacatagactcagcaaaggggtggagtttcctgggaactttttgaacttattagcttacttcttttttctaaactctcattatggaaaatttcaaactcacaaaagtaggaagaatgcttctatgatctcccagatacccaccacctgcctcagcaattatcaacgttgtggcattcctatttatctacctttttttggctgatgtattttaaagaaaatctcaggcattctaacatttcacctttaaatactttagtatatacctctaacagataaaggctaatttttaacataagcacacaatcattatcaagcccaacaaaattaacaataattttttaaaatctaatacccagttcgagttcactttcccaaagtaccttggaaatgtcttttacagttgtttgcttgaatcaggatccaaacaagatccacacacacatggctgacatgtctcttaaagccctttttatttaaaacacccccgtcctacacacacgtttccctccatatatttgttgaagaaactgggtcaggtgtcccgagtataatcatttggcgtgactagaatcaagtttacttttaatacgtctctcttgcccataattcctgaatgttgttcattagatttacaggctgactagattcaagttcaatttttttggcaagaatacttcctaggtggtgctggtacttcctattcaccatattagcaaatacatatgatgcagactgtcccacttttagtgatgttgaggtcgagcatttgcttcaggttgtgtcagcctgacccaaccattatacaattcacctggagaacttaaaaaaaaaaaacaacaaaaaagattgcctacgtcccaaaccaaacctcctgaatcagaatatcttccccacctcctccatgtgtttaaaaggctccccgggccaggtgcgatgggagcactggagtaatcccagcactttgggaggccgagggggggcagatcacctgaggtcaggagttcgagaccagcctggccaacatggcaaaaccccgtctctactaaaaatacaaaaattagccgggtgtggtggcacatgcctgtaatcccagctactcgggaggctgaggcaggagaatggcttgaacccgggaggcggaggttcaagtgagccgagattgcaccactacactccaacctgggtgacagagtgagatcctgtctcaaaaataaaaaagaaagaaaatactttttaaaaaaataggaaattcacccctttggaaagtggcagagccaggtgtgaccccaggactccgcatttttaagtcaccacaggtggttctgctgcaggtggtccgagtatttcccttggtaaaatacggtgcttttggcgctgttccattccgggggctgtcacctggttcttcaacacaaagcttgtcctcaaggaacccacagtcctggggcagcgagcatgtgcactagtggcaatcacgtggggaggaagcggtcagtgccataaaggcagttcagggaaactgctgggagggcacagcagaaggagcactcactgccagctgggaagtcatggaaggcttcctggaagacaggcatggagctgaactttgaaggaatcaggttattccaggggaaggggcagcactggcagaagaacagaggcaaagggaaatgctatcacctttcgtggggctgggggagttaatgagatgggaacgaccaaatatggagatcctaaaagaaagaaatgaggcagagacaaggtccacttgagtagccgagtagactgctggggacttgctcggaggcccagggacttacaggaacacaccctatcaggggtgctggtgctcacacacagctcaacaggaccctgctaatgaagggtaatacttctgtaccaggagctggtatcagcgcattacacaccctgccccatgaatcttcacccacatccctatgacgaaggtgccattgttccttctatcttccagaggaagaatttaaaatgtcacactgctaggacatggcagagctgggattcaaaaccaggcagtctggctcccagagactgcattcctgaccactctgcttccctgccgctcaccctcttgaagagtgaagaccctagcagcctcctgcccatggagcatggggtcctcatagcaggcctctcctcctcatacctctgccttcacctcacaagctcagggagtcctcctgcccctgccctgctccctctgtctccccctcagggctctcttgggtttctgtgcagcaggatactggctccctcgctcttcccttccttttggttcctggacccaaaccacaggcctctttcctttaaggggtcactcctgttctctgcagacccagaacaggggttaaaagagcaagagacaaggctgcggacaaaggttttgagtctcccacagtgctcagagccgtgttccctggttcccagctgagctccctgtggacagcccctggggaagagcctgctcaggagacagaggccctgaacagcttgtcccaggtcatagaatagcccaggagcacagccaggactggaccccaggaagcagagctgccttccgctggctctaccagtttgtttgggatggagctcagcgatgagctcacccttccctgctgccagaggggccaggacctgagtaaggagctgggggcggcctggccctctcatgccagcagaaggccagccccaggcttttggccaaccttgcactgatcttgcccatcccccttcctttccgttgctcaaaggtggcttcacagaagacactggcggtgtcagtagtgtgggaggcatgtactgcccgtggcctgggtctgccccatggggttcttctctcttccagagacctaagccaggaaggccaaacaatccccacccccatgtgtccctaggccagtgacgctggggccagagtgggcagtaggactctagaccacctcctaggttcctggcagcctccctggacttacaggtggcaggaatgggccgagccatgccttagggccagaagataagaggcagggctcaaggggctacaaatgccagaggtcaaggcaagcaagggtctgacactgggcagacaggagtcaggactggtgatccacagcctacctgactccctaccccctgcattttctccccaaagctgcggttacttcatccccctaagttcaggcctccttgtcctgtcctaggcacaatacagaagcccaggggagttggctttcagaggatctggttgctggcgctccactggcctcgtgcttcctttctggtcaatgggcttcctccagtaaccaagcttctatcttacataggattacaacagctgccattctgtgtcataccacgcacttcacgtgtatcttattcaacctcacacaacccggtgaggtaggtctgatgcccccagtttacaagtgaggacattgaggcttaggggtagccctgctggccatattcacaaactggcagggggaatgaaggtaatctgtcctactcaggagcccaagctcgtaaccaccgtgccatggagctgcctcagttccaccctcaggatcctgtgtcccacttccaggacctggagtgtgttttcacctacacttgaatccctgcctcaatcttagccaacagttccctgcttccacaaccaaggtcctgcagagagctgcccacgcccgggccccacctgccctgcccggggtctcctgaagctgactgccagtttgccaggacttgctctctttgtccccactccctccctccacctcagggcatcctttttttttttttttttttttttgagatggagtctcactctgttgcccaagctggagtgcagtggcgcgatcttggctcactgcaacctccacctcccaggatcaagcgattctcctgcctctacctccggagtagctggtactataggcgcaggccaccatatctggctaatttttggtatttttagtagagatggggtttcaccatgttggccaagctggtctcgaactcctgacctcaagtgatccaccccgatcagcctcccaaagtgctgggattacaggcgtgagccaccacgcccagccagctcagggccttttcatctcttgtaggggtgggttgcccctccacacctgtgggtgtttctcgtaaggtggaatgagagacttaggaaagaaaaagacacagagacaaagtatagagaaagaaataaggggacccagggaaccagcgctcaccatatggaggatcccgccagcctctgagttcccttagtatttattcatcatttgtgggtgtttctcgaagagggggatgtgtcagggtcacaagacaattgtggggagagggtcagcagacaaacacgtgaacaaaggtctttgcatcatagagaatgtaaaggattaagtgctgtgcttttagatatgcatacacataaacatctcaatgctttacaaaaccgtattgctgcccgcaggtcccacctccagccctaaggcggtttttccctatctcagtagatggagcatacaaccgggttttataccgagacattccattgcccagggacgggcaggagacagatgccttcctcttgtctcaactgcaagaggcattccttcctcttttactaatcctcctcagcacagaccctttacgggtgtcgggctgggggacagtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacatgtttcagagagcacagggttgggggtaaggttatagattaacagaatctcaaggcagaagaatttttcttagtacataacaaaatggagtctcctatgtctacttctttctgcacagacacagtaacaatctgatctctcttgcttttccccacaatctctcgcctggaccccagcatccaaacagatccccctgccccaggtcttgttccctctaatcctccctcaactgcagccagagtgatttaattgtatcaccacccccactcctacttaaaccccccactagccaagaagctgatccaaattcctttgtatggcattaagcgccctgctttccagcctggctgacctcatctctctccggccctcccctcctgctttgttccagagccaggtggaatgaaactgcctgtctctggactgtgtttattgcattccatccgccaggaatgccacccccacccttcctctcctgccccctgaatccgttctcctgactaacttctgatccttcaagactgagcttcaacttcacctttgtgaagctttccctgaacatcttcctccaggtttaaatgacccctctctcctcagaatccctgctcgaccctcccagacattcttaaagcacccagagccctctgcctcacttgtcactctctctctccttgtccctgctctgcagagaggcttgggaggcaggggttgtgcctgatttctctgtatgtccctggtgtccagcacggggcctggcacagggcccgtgctcggtgtttgctgaggtaatgggttggctgaccgactcatatctaagcaggtgccctgggcacctccccacactcctctccacagggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggtgtgtggcagggagaggggggactgctccttcctcggggctgggctgtgactgcctacctgtcatggggcaggggacgagggagggggacgttgctatcatcagcactgctgctgtttctctgtgtgtgacctttacagacttccaatggctttgcctggccagagggcaaggcttcccctggcacacctgggaaacctaggggagggtctgagctgtaactgagagggacaaaagtgaggtgagggccacccattccctctcctttacccctccccttccacactcttccccgtcccttcatgcttctctccctccctcccacaccagatggtgactgagtgctcccatagattccacctctagccaggcaggttcacacatctgcaggagtaacggtgatacagcgtgatggggactataaccagagctttgttctttaaaaagaaaaaacgagggccaggcgtggtggctcttgcctgaaatcccagcactttgggaggctgaggcaggcaggtcacttgaggtcaggagtttgagaccagtctggccaacatggtgaaaccccatctctaccaaaaatattaaaacaaacaaacaaaaaaattagccaggtgtggtggtgggcaagtgaaatctcagctacttgggaggctgaggcaggagaatcacttgaacccaggaggcagaggttgcagtgagctgagatcgcaccactgcactccagcctgggcaacagggcgagactccgtctcaaaaaaaaaaaaaaaaaaaaaaaaaaaaagaaagaaaaggtgaaagatgagaagctactgctatctaggtaagatatgaaaggcctcctacacacctctctcccagttctgttcacactggtatgtgaggttcttgttctggtcaagtcaggtgagctagggagaccagtttacttgagcaaatgcttgtcaagacagcacaggcacccacagcccacaggctacggagcacagaaggagggctccctctggaggagatgacccagccagagccctggaggacaggcaggacctccacaagtaaagcagcagagaccaggtgggggctgtgggtcccagaagctattccaaaggtagaacaacaggatctgctgacagatcagacatggggtgagaggaaggagggagggtcaaggatgcccccagggtttccagcttttgtaattgtgaagcaatagggtccaccagtctgcagctcaaaattctaggctggaggccgaggcgggcgattacctgaggtcaggagttcaagtctagcctggccaacatggcaaaaccctgtctctactaaaaatacaaaaaattagcctggcatggtggtgcacgcctataatcccagctacttgggaggctgaggcaggagaatcacttgaacccgggaggcggaggttgcagtgagctgagatcacaccactgcactccagcctaggcgacagagtgagactccgtctcaaaaaaaaaaaaaatctaggctggaatacttatttgggatctttgttgttcaatacagtaaccactagtcatacactagtatgtattaaataaactactattaaataaactagtattaaatttcatagtaatgaaatttaaatttatatttattaggccgggcgcggtggctcaaacctgtaatcctagcgctttgggaggccgaggtgggaggattgcttgaggccaggagttcaagaccagcctgggcaacaaagtgagacccctgtctctacccccccaaaaatatattaaaattatcatttcagttatagttctttagtgggtctcagtcacactaagaactagtcattcatcttaagacctcagtagccatatgtggctgtggctaggggctactgtagtgaacgatgcagatatggaccatttccatcatcacagaacactctactggacagctctgatgcaggtctgtaaagccatgagcctggatgagaccacctagagcagtgattctcaacttggctgccctttggaattaccttgggattctaataaaaaaacacagacacccagccctcagctctagagatttggttttattaatagttgggtattgggcgtggtggctcacgcctgtaatcccagcactttgggaggccaaggtgggtggatcacttgaggtcaggagttcaagaccagcctggtcaacatggtgaaaccccatctctgctaaaaaaaaaaaaaaaaaaaaaaaaaaatcacctgggtgtggtggtacgtgcctgtagtcccagctacttgggaggatgaggcaggagaatcacttgaacctgggaggcagaggttgcagtgagcttagatcacgccactgcactccagcatgggggacggagcgagactccttctcaaaaaaaaaaaaaaaaaaaaaaaagttggagagctggcctggtgcttcctgaacatccagtttgaaaagctcccaaaggtgatcctaatatgcagcccaagtgaagaagcactgacctaaggatgaaaatgtagagacggaagagaagaggacccaagggcacgccagcctctagagtagggcagatgaggacacgcagccagcaaaggagactgagaaagaacagcccatgaggcaggaggacaaccaagagagtgtttccaggaaagtgtttctatgaatcttgctgctcaaaatgtagtcttcagaccagcagcatcagcatcacctgagagtgtgaaggaatgcaaactctcaggccccaccccaggccctctgagccctcatctgcattttagcaacatccccagatgatgcatgtgcttattaaagtctgagtcaagtaaccattggatgatcttggcagagcagttggagtgggtgacgggtagaagctgcactggggtgggaaagagaataaatgaagggggtgaggaagtggggccagtgcgtgtgaagggggcaaagagggtatggcctaaggaagagcgctgaccctaaggaaggacatgattgctctgtaacaggagagagaaaagagaagataccagattcggggatggaaagatgagagtcccattctaatggctattttcatccattttctcaaagactgggggagttaaactggggagagggaacaggaggctgaactgggacagacttgtctcagagctgcctgggtgatgctgagactggcaatgggaggcgggaaacggctgccccctctctaagatgcagctcctctctccaggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggtagggccaatggattggcaccacccagctggcccctgacctttcctcctcctccccgacatcatggagctggggaaggctcctgatttgggattcgattacaatggggcctggacaggagctagcccagtggccagggcatggggtctcttcctagtgctgctgggtgaatcaactgttcccaagagggagggggaaagatgggtgatccctcacctcccctggggttaatgctgggagaaagtgctggaagctggcttctggtctgtgaccacccttcttgggacctcagtttctccatccgaaacctgggggagtcattcctctaacaaagagtgtgtgaagatccagtgagtacccggctctgaagatggtcaacttggagtaggggctaggtcagtggtggctgagtctgactccagaccctaccaaggcttgaggggctgctactggcagcagcccagggtatatcttgtcatctgtcctccatcagccatggactgacagggtggcagtctgcttgacgtgttgcaggttgggctctcggggagtgaactctgaggtggggtctggaatgcaggatttcgattagagagtactttcagaatcaacatttgtgagggggagaaggaagcaggacagggaagagggagaggttaagtggcaacagaggcccatggcagcctcagccacccccgcagggagctctggggctacggtggcctgtcactcagcctacgttgggtccaaaatatctggaacattataacccctacctcattcaatcactggatgaggaagggcatccagtgactgaggagagctctctgaagcagggaacatccccaaaggggctgacagttgaaaactgcctgctggccacactgctggccactggggcaacaagcccttctctgaaggggatctgggcagggtggctccatcacacaggatggtgaaagaggctgcctcgctccccttgtggagttctcccagcacgcactgagcactgcgcaggaatcgggcagcgtgagtcagccccagtctggcttctcactgagtggctctaggcaagtcacctggcctttcttaagactccgtatatctcagatcaacttaacagagacatgaaagtcaaaataaggtcaaaaacctggatgtgaaagtgctttgtaaaacaccttttaaaatactagcttttgtaccatcttttacaaatcatgcttcttcttctgcactcattctactttgatccaactgaaccgttcataggcaggtccgggttttatcatccccatttacacataagaaaactgaggcctggaggctgggcgcagtggctcacgccttgcaatcccaacactttgggaggccaaggagggcggatcataaggtcaggagatcaagaccatcctggctaacatggtgaaaccccatctctactaaaaatataaaaaattagccgggtgtggtggcgggcgcctgtagtcccagctactcaggaggctgaggcaggagaatagcatgaacctgggaggcggagcttgcagtgagccgagattgcgccactgcactccagcctgggtgacagagcgagactccatctaaaaaaaaaaaaaaagaaagaaaactgaggcctggaggctacaggccttgcctagactgcttgtgtaccagcccaagactgaggcaccagttacaagaggcgtttttactggactcggactatttagctgccatttactcaacatggactgtgtgccccgtactggtctgggcattttgcctagaatctctcatctgattctccattattacctgcacttgcaggtgaggcctaggtcatgcagctataaatggaggaatgtgaattcatgcccaggtctcgagggaattcccatgacttggcttccatgatcctggccctgctggatggagccagcctcatggagggcgctcggcccaggctcagtgaccaccccagcctcccactgtcccgaggaccagtctggctgatgtcagtgacgctccactgcccccatgtggccactccaggccccaacatcatcctttccggctccctcacacctccttttccacaccaggcctgtctgctgtttgtctcattgtccacccagcagcaagagtcagcaggaggctgaattgaagacagttacaggagcatcctgtcttcctcccagggctttaaaagtcagaagcagctaatggacagtctcggtggagggctgggctgttgggacctaagccccacagctgcaatcactgggttcggaggcagggcctgacacacctctctccccctctcccgcttcctcccaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtaatgtagactgtgctgtgggacagttccctgcccaaggtcttgggacctcctttttcccatctaaactggaagaggcggggtgggaggcagatgtcctcagagggcccctctagtctaacggagacactgacctctgacaaatcaagtcagaaagtgagactgagaatctgtatgtgccgagattggtggggtgaccagcttcgtccacatgaagtagagtgtgggacaagcaattgaagaccacccagtacctcatgggaggccatcgggtcagttctgtaagaacccagagggaagaggtcactcaagctggggaggtcgggggagggtgtgggagggagctaaggtgcccaccctgtacccagcactgtgctaggttgtttcatgacagttatcttgactcgggccagacctcagatgggtgagatacagatagtgagaagcaaggaaggcattccagagggacaacggctgaataaaggagcagggctgggatgtgtacggacggccacagggcttagaaggcccacctgatggccacggaggccccgccttggaaagctgtgagaaatggcccagaaaggtcatttggaggcaaatcctgaagagccctggctgccaggccagaatgtggtcttgatccattaggccaaggctggaaattcatggaatgtttccgagcagcagagagccagagggcaggaggtgacagacatggcaggggcagggcagccatttctgaggtggttctggagcgcgccactcatgaggcccaaatgagggaggagccgtgcagctgaagggcaggggacagctgccaggagagtcagagggcctcagaagtggctgaatactcggccaggcgcagtggctcacgcccgaaatcccagcactttgggaggccaaggctggcagatcacctgaggtcaggagtttgagaccagcctgaccaacatggtgaaaccacgtctctactaaaattacaaaaactagccaagcatggtggcacgtgcctgtaatcctagctactcaggaggctgaggcaggagaatcgcttgaacccaggaagtggaggttgtggtgagctgagatcacaccattgcactccagcctgggcaacaagagccaaactccatcttaaaaaaaagaagtggctgaatactgagaggagaaggaaagagagggtcaacagtgaggctaggactccctgttggggacctgggaggcagaaggtgatgaggagggagcccctctgtggtgcagatgaggagctctggggagccagccaatgcagagctgccggtaggccgagggaggtcagggtttctggctctgctgctcaggtccagtgggagagcctcagagtcgggtgtcactggtagcaggtttggggagtggtagtgcatatgcaaagtcatgtaagtggctgagatcaccagagaggagagaggagcaagtcacatgaacaaaagagggtgggactcggagcccaggcagcagaggcaagttgtccaggatctgtgactggcctcaggcttcgtgcccttcccaactctaactgggccaaggggctgagggcatcagactgttttcacctgacaccctgaagatgggcaaacggcactgagtgactggggaagctgatcctgggctcctcttggccacaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatgtacgtaagggccgggccagggtgggcatggggagccggttttatgtggtcctcaccagtgcccacgggcatactcagtgcccatgggcgtccaggtttgaaaaaacacctggtggcagacaactgcctcatatctacccatgttcacgtggtccattaattcacttaccagctgccaagtcacactttttcatctgcaggaatgattcacggcagagagacgttgtcatagactgacttcattccttcagacagcatttctcaaacacttatcctcagtgtactccagggacgccttgagttacccaatctgaaaagcaatgatgggcatgcatgtttcaaagccactttttcacagggctcgagggcaagaagatggaaagaaaaccttcaaaaaaaatttttttttaaattctaagagataaggtctcactctgtcgcctaggctggaatgctgtggcatgatcatagctcactgcagcctcaacctcctagtctcaaatgatcctcctgcctcatcagcctcccgagtagttgggattataggcacatgccactgtgcctggctaatttacatttttttgtagcaacagggtttcactatgttggccaggctggtctcaaactcctggcctcaagcaatcctcccacctcagcctcccaaagccctgggattacaagtgtgagccactgcatcaagagagaaactttttatgtttcctgaactcctcctagaagccatgctggccaccagcccccacgactgccatcagacactcagcctgtctccccaccagcctaggagcttctcaggaggagctgctagcctggccagatgcagagtgggcctccaggagtgtttgttaaatagatctccattgatatggtcaaaaacacagactctagagctggactggctgggttcgtaaccaccatagtaccactcactatgaatctgagcaaatctttaataagttttctgttttctcatttataaaatgataataacagtacctacctttatataatggttttgtgaggattaaagaagacaaattatgtagcatacttagaaataatgcctagcacaccatccatgctgtatattttagctgctatcgtcatcatcattgtcatcatcatgggtttcagtttatgtggattgacaggattcattcactcactccataataatagacagcttgtgtggtgggagctggggacgtagcagtcaacaggacttgcagacgtccaagtctaggggcataaagcaagatggcaacagacgctataagggaaagactcccagcactttgggaggctgaggtgggaggatcacttgaggccaggagttcgagaccagcctgagtaacatagtgagattcatctctacaaaaaaaaaatacaaaaattagctgggcgtggtgacatgtgcctgtagtcccagctacttgggaggctgaggccagaggattgcttaagaccaggagtttgaggctgcagtgagttacaactgcaccactgtactccagcctaggcaatggagtgagaccttgtcttaaaaaaaaaaaaaaaggaaataaatgctgggagagagcaacgagctagagggggccgtgttagagatggctgggaaggagtctctgaggaggcttcactgctgagaaagccaatggccacagctgctatttgttggctgtcttgtatacctgatgctttacgcacaagatctccctttttggggagcctcagagacaggtgacatcaaggaccgagaccaatgaaagccctagccacggtgggaagccagccaatgaggacggcctaagcaagctgctttgcccactggctgggccgctcaggctgttgctcgagccctggggtggttgcccagggagtgattggcagggctgcccagcctctctcccagaaggctcccaaaggtcctgcatctgtgttgtgaagtgatgtgtgccaagccaaaaaaatccataattgcagagaggtcttgctgtcaacacaaggtgaaatcttgctccctgcctcccttggctcaagcaggagccaggctgaggcttaatggagcccacatgagcggggcaagggggacctgtgcgcacagtgtgacagagctgtgacccaggcttgcgtgcaaggggtcctgtctgggcagcacaaagtgaaccatgtcccagttctccctgaagcccctctggtttcctagcacccgtaggatgacaggcggaccactccaggtcccgggtgtccccctctgcagcttcttactccatgactcagccaagcactgcaccccaaacctccaggtgtgcccaccttgcctcccttgccacagtgcctgtgccctccttttcacactgccccagagcaggtgccggaagtgtctgggagtggtgatgctgggctgtatttctgcagattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgccgcttagctgagcccccatggtctgcaagaagagaagccctttaaggtctgggtcgccgggacaccccgctagggccccgccccggctctgccctcacctctcgcagccagacccgcgggtctcccggaacccacctcggcgtcgggaggagctggcgccgtgacgccaccaccgcgtaccgacctcaccctccgtgcgttggagcggaaagaagggactcgaccctgtgcttcggggcggggctccgcgaccgtcccccgccaatcccgccccagcgcctcaaggccccgccccgcgcaaggggacggaatgcaccccaacagcctccaagacgcccaggccaggaggacgctgggaacccgctgccccgccccacgcccacccaggaaaagacctgcaacctccatccaccttagtcaaagaatgccccgaagccagatgccccagagctctcacaggggacttgcccagctcaggggaaaatcggaacggactctctgcctttcaaggccagagaagaccggcgcagaagtcgggtgaaaactgtgagaactagaccgggcgccgtggctcacgcctgtaatcccaacactttgggaggccgaggcggtgggtcgcttgagttcaggagtataaaccagcctgggcaacacagtgacttcgtttctacaaaaaaataaacgaggcgagaggatcgcttgagcccaacaggtcaaggctacagtgagccatccttgcgtcacaacactccagcctgggtgacagagggagacactgcctcaaaaagaaaaaagaaaaaaggagaactgtagtggagagtgtttcttgccccaggatgaagcctcacatcctgatggtagaggagaagggaatggcgtgtgtggaggtggtgaactgggttgggtgtgtgttgtgttcatcccaccctatcttcccagaatgctggaacaactggagagtgcagggattgtacacaggctgagggccccaaacatcacattcagaatggcccggagggaactgcactttaatggggtggcacaggacagcagaaccctcagccagcagccacagggcctgccagccagcacaacagagcaggtttttgcagtaatgatagatccaggcgataagcacaggtggaaaagggttgggtgcccagcccctcagtcccagtgagctctctgccacctccctgccagcatccggtacagattgggcggaatgtggagaaggttggccacagtccagagccaggagcccatggaacaacttggaaggtgactcaggtgaggctgaagagaaaggaaagcgcacggtcagtagctgtttcacagagcccacctcactctcaagtgaggtgcctgcctcagccctcatcccgggaccagctctgacaagctgctcaagcagctactgctctagtatcctagccctgaaaaaccacaaagatgaggattagcagatgctcaagaaatattttttgaatatgctggctcttatctgctcagcagtgtacagatatgctctcacactcgagaagctaccagaacaaactggtaggctcccattctagatgacatcttttccccatactctcaaaatgcaagttaacccccaaccctgagcagaagaaaggagaggccccaggtacctgtcaatgagggaatcccgcatgctggtggcaatggtgctaggctgggcttcattcagcttgaagacactctccaccactgacagctctgtgctggttgtgtccaggccacagaaggcacaccagtcattcaccaccatcccagcagcaatcacctcactgcctcggttcacagtccccgcctgccaagggatgggctcaatgtgagtcacggcaccaaattctctccctcctcaatgaagactctccccaaaccctgctcctccctgacctgcagccccagtcccaaactgtggcaggtaatgacccagactcccaaacactaggcaaaaggatctgcctcgggagacggggttcagaggacaggaatgcttaccacaagggggacttgaagaagagaggacagctcatcctggtcttcaattgaagtcttgggatgcaccagccctccctgattgctgaagacacagtagcttcctactagcacctggtcggccactgtctgtctgaagacttccaccttgagcacatctgccagaatttcttctgtctcctgtcaatcaaagatattgtgttcagggctcagaacttacagccccagaaccaaggttctccatgcccagaagcatccaggccttggctccctgagcccctcatttctcctctgtacctcatatgaaagcctcacccagagaaaggaggaagtacagcttagagcagagtcaagggcagctgtgaagcccctaatattcatgcatgccctgaacagctggaggctggtctcaatatcacttctttcccctctcacccacagtcaaaagttcaacagtcaatcacctatcctggcccaggatgcaggactggatggttcaatctccccaatcatgaaggattcataccctccccagcttctttctgacacttgataaggcctctgttatcactattccaatgagtacctgaaactcaagagcccatatagaaaaaccacaggagagacccctaattgctgcctgttgggaaagaacagtggctaaccactgactaggatggccctgtgactcttgggtcaagttgggctgcctcaccctgtccaagtctgggtggaccaaggccacgtagtcattgcaggtggtgacattgcccaaggctgagagccgctcctccacccgcctaatctgcactgtgtctgggaggctgttgcgaatgtgttgcagctcctggtcggtggtattgttgggtaccaggagaccgtgcctgttccctggagaaacccaaattagagggtgaatacacaagatgcctgctgagccctaggggctgaggataccactcagcccagcccaatcagctttcccaggaaagctttaggcccagagcccagccctccaacccactgatctggaaaacacccagggcaggccagagaccacccaggaatcccaataaatcctgcctacttcaccatcaccaactgggagggaagctgagctcttggcattagctgtatattttgctacttaaaaactgagctgccgggcgtgttggctcacgcctgtaatcccagcactttgggaggctgaggtgggcagatcacaaggtcaggagatcgagatcgagatcatcctggctaacacggtgaaaccccgtctctactaaaaatacaaaaaattagccaggcgtggtggcgggcgcctgtagtcccagctactcgggaggctgaggcaggagaatggcgtgaacccgggaggcggagcttgcagtgagccgagatcgcgccactgcactccaacctgggtgacagagcgaaactccgtctccaaaaaaaaaaaacaaaaaaacaaaaaaaactgagctaacactacacacatagcagaatggctagattattattttttaaggcagagtctcactctgtcacccaggctggagcgcagtggtgcgatctcagctcactgcaacttctgcatcctgggttcaggtgattctcctgcttcggcctcctgagtagctggaattacaagtgcgtgccaccacacctggctaactttttgtgattttgtagagatggggtctcactatgttggccaggctggtctcgaactcctaacctcaggtgatccgcccacctcgacctcccaaagtgctacgattacaggtgtgagccactgcccccagccagaatgactaaaatttttacaagtcatcaattccaagtgttggcaaagatatatggagcaactgaactctcatactgagacaggagtgtaagttggtcaatcactttagataattatctggcatcatctgcaactactactaaatagtcacataacctgtgactctgccatgccactcttaggtatcatatacccagtagaaatatgtacatgtgttcactaaaaaaacatagcagcactattacttttttttttttttttgagacggagtcttgttctgttgcccaggctggagtgcagtggcacaatctcggctcactgcaagttctacctccccggttcacaccattctcctgcctcaacctcccaagtagctgggactacaggcacccgccaccacacctggctaatttttttgtatttttagtagacacggggtttcaccgtgttaaccaggatggtctcgatctcccgacctcgtgatccgcccgcctcggcctcccagagtgctgggattacaggcgtgagccaccatgcccggccagcagcactattcctaacagaccaaagtgaaaactgcccaaatgcactgtcgatggaatggatgaatacgttgtgatatacttacacaaaacacaccatacagcaacaagaatgaacaatctacaaatacacgccaatcaatttctgaattccaggtcactcccatcataaaatacacaaggactaagctaaaatctcccttgttgtcagaacttgcttcaagtcctaagggcatggttagagatcagagtattttaactgaataggaaaatactttgaggtcactaggcttaagtttttgttgttgttgttttttgttttttgtttttttttgagacacagtttcactcttattgcccaggctgaaatgcaatggcacaatctcagctcaccgcagggtgagctccacctccagggttcaagcaattctcccgcctcagcctcccaagtagctgggattataggtatgcgccaccacacccggctaatttctgtatttttagtagagacggggtttctccatgttggtcaggttagtctcgaactgctgacctcaggtgatccacctgcctcgacctcccaagcaggcttaagatttttaaaaattaaagtaaaagtaaaaaaataaaataaacagacttctaaaagtgacctcaatgagcagaactaagaaacaatgggcagcagtaatggaagacagatccagcttaatgaaaggaccggccgggcgcagtggctcacgcctgtaatcccagcactttgggaggccgaggtgggaggatcacctgaggtcaggagttcaagaccagcctggccaacatggtgaaactccatctctactaaaaatacaaaaaaattagccgggtgtggcgggatgcgcctgtaatcccagctacttgggaggctgaggcaggagaatcacttgaagagagtgttgcagtgagccaagatcgtgccattgcactccagcctgggcaacaagagcgaaaactccatctcaaaaaaaaataataataataataaaaaggaaaggaccaacgaccagaattaacagtgctgacaggtaggaaggtagggtagagatgtggtaaagggaatttaagattccaacgtaactgagcaggaagaccgcatatcttagctaatctttacagagacagaaatggatgcttagaaagagaaagcaccttgcccagtcagtggcagggagagatgagatacaaatcctcggctgggtatagtggctctcgcctataatcccaacactttaagagaccaaggtaagaagatcacttgagcccaggagatcaaggccaggctgggcaacacagggaggccgcgtctctaccaaaaatgtaaaaattagccaggtgtggtggcacgtgcctgtggccctagctacctggtaggctgaggtgggaggatcacttgagcctaagaagttgaggatgcagacagctgtgatcttgccactgcactccagcctgggcgaaagagcaaaaatctggcctcaaaaaaaaaaaaaaaagagaaaaatccttctccaacactaggaactaggtgtggaacttactgagtcacttaggtcaagtctcaacttcctcatcagtcaagttaggccagtaactcctaccttctagtgtctttgtgacgaaggaatgagaacaggagtgaaagcactttacattatttgttattactattatccagcagcctttgctagagggttgccccgatctcctgacgcttggcctgagagattctatagtgcccagagataacagatgataccctgggaatccctaggtcactccgggttccctccgggggtgtaattaatggtgcttggagaccactccctccctcggcgtcctccacctgccttacccacacacatgcgcccgatgatgcggcagccggcgatagacgcgtgcaccacggggatggtatcggagagctcgccctcgaacacactgtagggacatggactcggtggtggcggggcagaggggccggcaccctcccactgccggagctcttgactcctgcgcacgcctccccgccaccgtaagccccggggctcccgccgcacctgtagaagttctctgagcctccgatcgctaccagacagtaggtgttggtgagcttggcaaagcagccgatctcacagttgttctcgaacgaagctcggaccgccatgaggcctaggggcggcggaggcgggagttcaaggccggcggatcctttcccaagtatcccggcctccgtccctcaggccccgccgcgaccccgcccctctcggcctcccggcccctccgtcctcgggtcccgcccactgggcccccaccagaacctccggccctgaatcctctggcccccacccctcccgacccaggaccggagctgaccctcccaggttcccctcacaccagcttaccaagtaaccagtaacaagctccgcacgcggcgactgtaccttggactccctaaaaaggtttccgtttccacttccgtccagggagacttccgggagagcccggcgctccccgccacgcatccagcccctctacctccggcctccggcggactctatggtcgcgagcggtctgggcgcgaccccgcctggccccacgcctagcctgctcgcgttcattcattcattattcattcaggagctttttaggagctgtcatcgacctagacctccggctggtcggttgtgaggcatgagggagaggaggggccaggagtgtctcgcggaagggttgatgatggaggtattgatggaaatgaagccggaggaagggcaggtttggggaaagggatgagtccagctgtgccttgagggacagaagtccatgtctggagcccagcaggggagtggagtgctgacgaatgagatgaggggctgaagacgggtggactagaagaggctacccatggagagagttccaggaggcagaagtgcggccagaccgaggctggagaaagagcgcagccagagacggaaaggcagccaggctgcaggtgctggagagaggggaggactgaggaagcaggggctcaggaaaaggctggaaaggggtccagggtgggcaaggatgtgggtgctggttggcttccacgatgtgcctctcgcacggcctctatcactcactcagcagccaacttctgtccccaggatagtgatgggggccaagggccctgctgcacacttggacaggatgaacttggcccacattttgtagaatctgcaaaagccccgggttctctcaaaatgtcacagtggtaacttggagcccctggactcccccaattcctccttcggcattcaccctcctccaggggtttccccataattggcctgaatggtgcccttcccattcccccaacgtgtccctcccataactcctcaaagttcaggatacaccaggcgctgtgattcacaataaagtctgcctttattgatgtgtatcatgtttactatcccgggtaagtggtgagttcaggaaaatggcccacaacctgtcacagcctgtacttcaagagacactcagcaagatgatgacgacgacaatgatgatgatgatgatgatgactcagcaagatgatgacgacgacaatgatgatgatgataatgatgatgtgtgtgtgtgtgtgtttccgggtatccacatactctgctcttcctcactcattcacctcagacccactcagtcctctttagggcatctctttcacctgattctctctaccaaaaatttttctaactctctcctccctctgtccaaaacctccccatccttcagggcctggctcaaaggccacctccatctcctctaagaaagttttctgactactccaccttctccaggactctctgccctttgttttctaacaccctctgtaactggttaacctttaacttgatatggctctgaccccttctccagcagcttgtgcatttcacctctgtccccaggtctgagtgtgacccacctgtcagctctacaggcccagcacagggctggaaacacagcctagattcaagaagatactagttagggtgtgtgtgtgtgtgtgtgtgtgtgtgtgtgtacacaagaatcttgagcccagagagtgtgtctgacctgggtttctagacacctcccttccccagtctgggacctgagcaagtccagagtctcggtggacagaggaggggcctgcccttgccagtgcacccccgatgccagtcctttggctaggactcaaagcggcttcggagctgcttgaacttggacttgttgtacttagtgatgaggtccagtttgctgtgacccagggtcagccgtttctcatccctgaccaggtcactgttaccaccattgagatggccacccttgggacccccaggctcagttccctgcctggccccgtgcaactgatgatacttggtgatgaggtccagcttgctgtggcccagggttagccgtttctcatccccagacccagctccagccgtgcgagcagggcttgatatcgggagaccattgggcccaggcccctcaccacggaatgggccgaactttgtgatgaggtccagctggctgtgccccagggtctgccgccgctcatctggtgcccgtctggcaggtctggctgaggagttggtttcaaggggcactctggaaccctgggccttggggtactgcatcaggaggtctgattggccacggctttggtttagggacagcctcctgtcctccagggcccgatcaccaggtctgagggaacccaactcaggggcacccccagtacccagggctcgggacaggagatccagctggctgtcggcctggcttggggacaacctcctgtcctctggggcctgctcgccaggccgaagggggcctgagttgggggtaaccccagagtcagggtctcccacttctcgggctctggggaaggggacaaggagatccagctggccacggctctgacttggagatgccttcttctccttctcctccactgtctccagggttgtgccaggtacccatcgaccccgcagggggctgggctcttggcttcctgggagcccattctctgggaaccgggacagagctggggcaccccgatggaactggaggaggggccgggagcgaggaagcagaggtgaccccactgccaaggttaaggggctggtactattatggttgagggcaggggaggactgggaccatgggtatgcccctagcttgccgagattggccctatagagcccaggaggggagccgtggttagggtctgacagttggcgatgtagggagggctggccactggcctcacggcgggcaggacccagggacgaggacaccacacccgtatcactgcaatcaccacctcctggtagagcgaggtaggaggagcgacccataagcggtgactgcttgatgctgctgaggctggtgctggagggcagggacgacgtggggcttgggacatcaggcctgaaggctagggccacagggggaggacgcagtgcccggggagacagcgggtcctcaccgccacagaagccctccacaggctgcgactcagcgtacagacagcggaactcccggtcaaagtcttccacgatgcggcccctcagctgcagcaccatgctagtgtgggcctggctgcaaagccaggtgaagctgggggcagagggacaggggggtcaggaggcaaagtgcaggatcctgggggtcggcaggagtcacagccaggggtgcatacctggtccagcacgctagacccaaaccccaccaccacgagggctcacagcgaggggcagagctccaactccagagtctgtgcttgccctagccctgcttagtgtgtgacctcatggaggccccaacttccccatctgtcaaatggacttgggggaggttccctgaagtcactccagttccaatgggcatagtcattttctataccaagggtattaaagtaatcattcccctagagtgagctcctccagggccgatgcccccgacaccctcccctgagcctggcatgatgcctggcacatggcaggtactcagcccgtgtccgaaggaaaggatgagtggagggaagctcagagctgccagccagtgatgcagccccaggccccccttgcctcctcgtgcctgctcacctgtaactgcccgccaccacttgctcacagtcaatgaggacgaacttctccagggcctgccccgtgaagcggcggccagccttgctgcagtatgtgtccccacacgtgctccgcacacgcatgttctaggtggaagtaggttgggggtgaccttgagagagtgaggctcaagccatgtctctgccccatggggtctctaaccccagacagctaagggaacccaccccccactcccagtgccccccagtgctgactggccacccactggctcccctgccctccctgactccccgcccacacccctggttactgcccctggtcctcactgaccggcaggtgctccccattgaggtccatcttgtagcacatctccaggaagtgcctcaggtgctcctgggcaaggagcaggtacacagggacaccacgccggcttgaggcctccatgaggtcacacagaagctccatgtcagtgaatatgtccatcaccacagccaccacctgggtggggggaggcacacgaaagctcagcgctgcccagggcactccccacatccagccaaacctggggcaggaaactgggcgccgggaaaagagtactggactgaaaatcaggaggccagagccttcaagagcaagtgaacaggaagggcacttagcagtgacctagcccagggcttcttaacttgggcacaggcagatttgactgtcttcttttttttaagagtcagtgtctgtctcactctgttgcccaggctgcagtgcagtggcgtgatcatagctctcttctgcctagaactcccaggctcaagcaatctcctcccaactcagcctcccaagtagctggtattataggcatgtgccactatgcctggctaattttcttttcttttttttttttgagacagagtctcactctgttgcccaggctggagtgtagtggcgtgatctcggctcactgcaacctctgccttctgggttcaagcgattctcgtgtctcagcctctcaagtagctggaatttcaggcatccaccaccatgcccagctaatctgtatttttaatagagatggagtttcaccatgttggccaggctggtctcaaactcctgaccttgtgatctgcctgccttggactcccaaagtgctgtgattacaggcgtgagccaccacgcccagtcgctagtttttttttaattctaattttttgtagagatggggttctcacaagctggtcttgaacccctggcctcaagcgatcctcccacctcagcctcccaaagcactgggattacagtcaaatcccagcccagatttgactgtcttgaacccctagctgtttgaaagcatttgtgtgcatccttctgtgcaccgagtgtttatccatcatcagattctcaaagatgactgtggatcagctgtgctagtccaacactccctctgcactgagccccagatgggacagcagtgagaaggagaacccagaccccaattcccaggcaagttcctggcactcccccgactaactccagcccagctctgacccagggactgtctgtctgaggctcccttctccagggtcacagctacaagccacttactggggtcttcgctgccctttcccagtcctgcctcagtttccctgtgaagccacagaggtctggtgtgaccccttacactgcagactcccttacttgcacccatgccaaatggatccaagttttctgctcagttgagggctgggctggggcttgtgcctccatcccatataaagggctgcctcaaagaggcccctgaaaccttcttggcacctcccagcccccagctggcctttcttcccatggcatatatctgctatgagagtcttctctcccaggcagggccgagaggcaggaggtacagagcatagcactccagctctggagtcagaaagaactgggttcaaacctggactctatcacttcctggtgacacagctttgggtgagtcccttcacctctggaagcctcaccttcctcatctgttaaatggagataatgatagccatgtctcagagttacagggaattaaatgtgaaaatgctcaagacataacagagctctataaacattgggctgcagggcaacgcagcatttcccaaggtcactaggagtcatgacagcccagtgcacgaacctggctcctgacccaggatagaggggtctaaatgggggctgagaaggcgaggcactgggggatgccctagttcacagcacaggcctggccagggtgggggaacaaggacaggcaggaagatcaaagaggcaggggtgaggaggacgacagcagcagcctcactaataaccccattcctgatgccaatcaggcctggccgtcccctgcctggggcacaggaaggcttgccagggaggctctggaagtaccggtgggatcccagcatcctggcttcccatctctgcagcaggagcctaactctccctcaaaccctgccagggatcatctcgtccattcccctggagtcggaggccagggcttcagaagggaagctgtgctcgtgtgtggccagagcctttctgggtgctgaccacccctacctgccctcccaattctctttctcctgagctcccgctccccatcactgagcccagcagcctcctctcctccttcctccttggttccaaagcccagccctcaaggccacgccaaagaggcccacacgctggccccttcccctgcttcaggcccagctgcagatgtggtgcaggagggtagggggcaactagggacctgagccagcaaggagggccggactggtccccaggacccaagtcagagagcccctgtctccccaagccctgagctctatgtcaccatatggacctccctgggcaagtcccaagcccctctctggcctcagtttcttcttctataagtgaaggaggtgactcagatgttccccaaggttggagttcttagtgtggggatcataaaactttttgagaatctgatttaaggcagtggagcatcttccaaggtaaagatgcagcgaggactcctccctccaacctgcaccacttcgtgtgcatttcaggggattgtggagtccctgacacccatgccctgttctatgctcatccatactattcctgggtaccaagcagttgccaaggtaaatatgggatgtcccccttctaggagtttgcaatctaatagtgccagaggtgctggtcctcattctgcccctaagtcgctgtgtggccttgggctggtcccttccctctctggacctcagtttcctcctctgtgagatgagtgatggagagatgaggcccttaccgtgtgggcctggctgaaaaggaagcgcagcaggtccttgatgttcttggccttgtccctctggaagtggaccacagcctgggtggggctgaagcctgtggcctgtggcacctcgggccagcccaggtccaggtctggggggtctatgtcagaggccatggggaagtaagtccctgaggtgacttcagagagcaggctgaggcggtctggcccggaggcctcctgcccctgagcctcgctgagctcagggcccccgcgcacatggctggtcatgtagtccacatccagggcgctcaggaagggcagctcccgctcctcggagatgacccgcaggtaggcagcctcaccccgctccaggagggcgtcggccgccagccgagccgcctcgctgtgccgcagcaccagcggtgagctctcccgccaccacggcagcttcagctcttccacccggccccgcaggggtcccgccatgccctgggctcccaggaccccaggccccgggcctccgaacatgcctgccacgcggctgcctcacccgccggcagggcccatggcccgcacgctgggctggctgcagcaggaagaggagaccagcagaaccgccttctgcccgcccgctcgctgtgtgtgtggcagggcccccaaactgttgccaccctaaatcagagccacgctccaccctattgcccctggcctctggaacctgtcaggtcagccccacctgtctgcctgtgttgggactcgcctgcccagggaagcggcagtgccaggccctcggtgcacactcctgcctccctctcttcctcccagcaacgccgccccatccccaccaggctcccagcaagtctccaaatgctgacttcccgggacccacagaggttgaattacagccaagaggggcccaggcgactcaggaacacacactcacacgcacacgcacacacactgcaggtgggtgagcgactcaagacacccaggaaaagacatgaacacccatgcagatggacacactgacaactgaccgatacacagacatggagtgtgggctgacacagaccgaccacacattgtaatcacatccacttgcataaactcttcacccaaacgccgatgtagagaccggccatgacccccacaacacataccacagtggatagcacgtgccctggctcaagtctgcaaggccctgagagctgaacgactgtcacatggaatatccaaggacatcaacgctggtctgtcccccagccagccctctttttgctcccataatcgtcctgccactctccatcatcttaactgtggtgctcacagccccctggctctctcccaccccggctcggagctgtccttcaagaacctagagcagtggctctcaccctgaccccaggggtggtgagaggtgatgaaatgcagatccccgggccccaccctcctggaaattctcatccagaaggtgtccgtaggcttctggagcttgtcttttttctttttctttttgagatagggtcttgctctgtcacccagtctggagggcagtggcgcaatcacagctcactacagctgtgcctcagtttctctggactcgagcgatcttcccacctcagcctcctgagtagctgggattacaggtgcatgttaccatgctcggctacttttaaaatttttttagagatgggatctcactatgttgcccaggctgatcttgaactcctggcctcaagcaatcctcctgtctcagcctcccaaagtgctgggattacaggtgtgagccgccacacctggccatttttcttttttaattgagacatgatcttgctctgtcacccaggctagagagagcagtgatgtgatcatagcttactgtaacctcaaattcctgagtttttaaacaagtgcccagtgcactgtgggcagtgggctaaggcccacccctgagacatgctgttccagatggctgtgcttgcaacacccttaactccagggatgttcttggcctggtggtggccagaccccagccttcttcccctcctccagggctgagtatgaaaatggttggaaggttgtttcagagaatgggcggacacactgcaaggtcaggaggcaaacagggcaggtagatttctgacctctgccccaacaaagattaaagtcctggagcatgtaccgtgtgtccttcggaggatggtgagcagctttgctctggggaagggggtgagcaggtgacagctgcagctggggagccaggctaggcagaagcggtcaccacctttccacggaggcatgaggtccagcgaggatggcgggaagcgcagaagacctaaagccgtgcctcgcagcctgtttagcactaagcgcacttggtttatctggtctgcgatcatgtccggaacacagggtcttctgtgtccaaagaacttgacacacatatagtgggagggagctgggtgggatttagaggttccggagttgagctgagccctaggaccaaaggtgaatggggctagggctgtgtcttcaaggaccctataagtgaagggcctgggggagcatgggggagccacaggtcaggagttatggcctactccatcccatcccaggtgcaggagcaccgggcactccaaggaggcccttccatgggggtgaggaggctgcaagaggggcagaaggttgagtaaacaaagccagaccgtgggagggtgatgagctgtgggggcagccgaggtggcagggccatcattagggccttatctccagatttgtttgaaggggaggaccaaccagggtcttatctgggtggtagaagtgctcccgggagggagggaggcatgtttgcgtgtcactgagttagttttgtttatcttgcagtgtgtatacatctacttcaggtacatatctttggctctgtatcttttaattgtggtaaaatacgcataaaatttgcctttaaaaaataattcgtggccagacgctgtggctcatgcctataatcccagccctttgggaggccgaggtgggcggatcacctgaggttgggagttcaagaccagactgaccaacatggtgaaaccccatccatctctaataaaaatacaaaaagtaggtggctgtggtggcaggcgcccataatcccagctacttgggaggctgaggcaggagaatcgcttgaacctgggaggcagaggttgaggtgagctgagattacgccactgcactccagcctgggtgacagagcgagacttcatctcaaaaaaaaaaaaaaaagaattagagatggagtcttgctctgttgcccaggttactctcaaactcctggcctcaagcgatgctcttgcctccgcctcccaaagtgttgagattacaggtgtgagccactgcaccaagccaaaatctgctattgtaaccatttttaagtggtacgctttaagtgtcgtaagtgcattcacactgtggtgtaaccctcaccaccatccatctctagaactcttctcactttgcaaaactagagctctgtacccactaaacacgaattccccatttccccctcccccagcccctggcgcccactattctgcttcctgtctctatgaatttgactcctctaggtatctcatttaagtggaatcatacggttttgtccttttgtgactggctcatttcacgtagcttcatgtcttcaagttccttcacattgtagcgtatgtcggaatctccttccactttaggctgaataacatcccattgcatgtatgtagcatgtgtgtagcacatttagctcattcctccatggatggatgcctgagttgcttccaccttttggctgttgtaaataaggcacaggtgtacaaatttggctctgtatttttgtatacttccccccacgcccaggtttgtactagattccttttttgtacataagaaaccactgaatattggcaatttcatatggtttgactaaatatatacaggtgtacctatgcagaactgtacctgtgcttgtatgtgtgtgcacgtcctgtctgtgatgtttgtgtgcccgtgtggcacggcagtgtgcatggacctgtgtgtgcatgtgtgtctgggtggcgggatagtccttgagtcggactctgtgttgcggtactggggctgtgtgtacaggaagcacaatggagaggggcaggggtgggaagactttgttgaaaggcaaggggttccagtggatcccggacatcctgataatacttgtgtgcaaatcaaatcaaatccccccaggctgcgggaccagctgcctctccctaggcagcccctccctgtgagttgagttggtcaagggcaatgggagggcagacaggtggctcccggcattggggctgggcctaggggtggtggccaagggtgatgggagcgtccagacagacccaagccctgtccctggctgaggtatgtcaggcacaggccccttaatgactgtaattaagaggaaggaaactgttttcctgtataggaggtgtgtcaggcgcctgcctggcatcactcagctgtcctggaggccacttagccttgtctattgtctctcacaagccaagcggcgtctgggcaggcaatgtcatgtagggtagggggagcagaggctgggttgcagccctccaggtgcaggctgctctgaggccagtgctgccgcatacctttcctctggcaccccgggtcaggagagacagggctcccgcagaggagcagctgggactgtagggcccggagtgccctaccagggatttggagtgcacccaaatcccttgaatcaaggcaaagtggacacatgctgaagagtccccgaggctggcttgagccaggtagcaaagggtgagaaagatttcaggtgcagaggggtaagtggagtgttcctggctggagaaagagggcaaggacatgcccaaggaaggcaggtgggggccgtggtgcaggggaagatgctaacaggaaggctagagccgcactaggaagagctcgagggccttctaaagtgctgggttcttacctagagatgatggcacaaaggctgggaagactccagagcatcgtcctaggataactcagaaacagctccaatggcgagagtgggccaaagcaccagaaacaacccacattggttgaacccagtgtggttcactgttcactgagtgtgacacaggtctcaggaggtcaccattccgcactcttgtctcatcctgataccccatgggctattgtgccactggactgagtcgaccccctggtaggaacacaggctctgccacttaatgggggagccgaacaatcacaacttctctgagtcacagtggctgactctgtagagtgggacccacactatctcctttacagggttgtcttgaggaatatatgggctcagctacgccaagtgcctggctgagagcagctgtggttgctcagtacatgctgaagtccagagctttcccagttgtgaaaggacaggggctcgatgaaggcctgaaagctcaggaagccaccgggggagctctcctggtcagtctctggttccttctagaccaaaggctggtgccaaggccaacacggtcccagccgagtcagtggggtgtggtctgtcaccactgcctctgagatctggcctctcatcacacgcctgctcacaggaggcggggtgtccatctgtctgtctcctgcattttatttctccatttgttttgaacttgggaggggaagaaagaggtgcatctgctgactcctggagccccgttattgaggcagcctccccttcccaccccctctccctctgtccaatcctcccagcatggatttagtgtccaccttcagccggcaggtgacccaaagatgagtaagagtttgtctctgccctggaggagctcacagttcagtggggaagacagactcataaataattataaaccatgcattaggctgaggtataaaccaagctcctggggtttagagcctggacctattgaagaacctcagacgagccatggccccacctcccgccccttcaagcaaggcacagcgcagtggcgggccctctcccaagtgtgaggtgaatgctgttcctggccacagggagagaaaaaaagtaagagcacccagcccaggcccgtgggtgctggttcctgactgaaacctgcagtgaggcctggcagggcctcagcctcccccgtccaacgcgctggctgggcgggaggtctccaggtgcttccggcgctaccgctgtagtccatcacttgttgacgccacgggttggtgcttggaggtcccttcctggaaattccccagccagggtctccaggatcttttctccttgttctcccctccacacggaaaaggggagcccgtggcctggtcagggtctgggtcctaggctcaccaacgtcactccagggaagtcccctggaagctacagagaacctgatgggggagcggggagggtcggggccaggggcctgaggtctggcctccccctctctaaggccaagcccagtggatagggtgggtgaggcatggtaggtgcagtggacagactagaagtgggaaccagagcaataggtacaggagggctgctcccaggggaagcgttcgaacacccctgccagctccacttccctcccactccacccccatagctgataaactctagatcgagaccagctggcatgagctctcccttcccccttagccctctcctcagaaactccttttccccctatcagtcctcctaatcgctggtctcaggaaaggattcccttcaccacctccaaagccaggcccttgttctcaagatcaggcttccatttccagagggatctcatcggagtccctaacactcatgggaagttccctactccactaagtgcttagctcatcagggtgcttcctgcccccaaatacatcttcagcacgttcctgcaaacccccttgtttcaccccctcttccgcctcctcccagtatccctccatctcttctcagcatgctgctccgagtctccttctggaagctctcctcttccctgggtccagtctaccttctgcactggtgcctgctcttcccgccacctcctgtgaatgctccttgcactcccaacccagtctcggggctgccctcacctccgggagctcatcaacttcaggatctctatacccaagacaaagccaacatccttcgtccctgaggtccatcctgaggttcgccaaggtccttcctcccccatgcccttgccctccctggagcatctctagcatctgaagtccatctgccaccagactggctccccacagatgcaaccaaggtgcaccaaaagcaatggagtggaacccagaaaaaatgactgttcagctttgctgcagggtcaccttgcaccagcaagcagattcttctcagtgcgcctatttccctattgcatcatgggtgcagcaatccctgccctgcccagctcatagggtgctgtaagtttcacttgaaaaaacacaacacatggccgggcgcggtggctcacacctctaatcccagcactttgggaggctgaggcaggtagatcacctgaggtcaggagttcgagaccagcctagccaacatggtgaaaccctgtctctactaaaaatacaaaaaaatttagcagggcttggtggcgggcacctgtaatcctagctactagggaggttgaggcaggaggatcccttgaacctgggaggcggaggctgcagtgagccgagatcacaccactgcactccagcctgggcaacagcagcaaaacttcatctcgaaaaagaaaaagaaaaagaaaaaacacaacacagagaggattcttctcctccaaagaggatcttctgccagacgtcaccatctctgggccccagtgagttctgtgactgcactctcttcaggctccacattaggcctcaagtcctgatgagttttttctcggaaatgtctctggggtttgagcttccctttgaattccatctgtcacccccggcatctcaagcccagatggctaaactcccttcctgacagagccaatccatcctggtaccactgtctctccactgccatcatgccccagtctttaccaagaatgcgcacagtggcttcctgctgcctggcagctgatgtgtgatctgtgctacccctactcatggtcccacctgatctctgcaacccttccttcccttagcagctaactcaacagttgctgcagtctgaagagcttcctgttctgtgccttcaactggacagctagtcctcaattcccgttttcctacctccttaagcctcactcttcacagcctgaagcggtggactgggtcagagccaccatacagggtacatctgggcattcccctcctggaatatgagcttaagaatcctcacctgcaaggcggcgagtgaggtgacaagtgaaaataccaagcaagcctggcatggagggaaaactcaaaagatgctggctgaagtgcggcctgggcttcaacctcagtttaagattcaccccgtcttgtcgtacagcattgctatttctcatcggaagaaatagcgatgatttcttttttcaaatttttaggtaaaacatcaatcttaggggtactgttcagtgtttctcatttgaaaacctctataatacagtcttctctgaagagtaaggaagacatatgtttcttctgatgagtaagtgtacttccttttatgtgacaatgggaactctacaaccttagggctttccattttccacctttgaccaggaagctcagagcaaggtctcatactcaattgcaaatctcctggctgacctgggggagggaggcagggtgacatggggacaaagcagggtccccagggtctgtcgtgggctggagcactcttggccccttcttatcctcgatcactctttctctaggcccctctaagcttcagtcccctcacttgtgttaaagggataataaaaatgatgagggcaatacctgttttacctgattgttgtgagacaatgcatttacagtattttataaaattttaaaaaagtcatatgaaagttgctcattagcagtccaggttttccaacataattattttccctctttttccctcccaatacctggatctgatctttcaaactttaaggatttttttttttttgagacagggtctcactctgttgcccaggctggagtgtggtggcatgatctcagctcactgcaacccccacctcctgggctcaggtgatcctcctacctcagtctcctgagtagctgggactacaggctcatgtcaccacacccagctaactttttgtagagacagggtctcactgtattgcccaggctggtcttgaactcctggactcaaccaatccgcccacttcggcctcccaaagtgttaggattacaggcatgagccactgcacccagcctacaattttattacaaactgtgtctcttaatctgctgtgatcttttctggaagaatacagaatacaaatattaataaatgacaaaatcattcctacagagcagtctccctgaaggcaagaaattgtgtccttcacttgttttgtacaataatgagttacactagaaaagcatttagctatggaaagaactttccattttggttcctatgctaagaccaaagggagtgctcaatattaagtcgctaaaataagtgaaactgtatgggtcacactgagaatggtccagaagggggctttttggttggggttgtattgataacacttggtgatttagtcacacattcattctttcatttatccaagtatacactgatgctgatcatgaatcaggcatttggctgagcactggaaaaacaacagtgaccaacacaaacacagtgtccactccacgctgaggcagctcacagtacagtgtaggaggtgggtaaaaaaatcattttaacatggtaaggtaagtgttaccagggctaggtgtggaggcttatgcctataatcctagcactttgggagggcaaggtgggaggatcaacatagtgagaaactgtctctacataaataaaaaggtaagtgctccagagcagagaaccacgtggggagcagcacggatatcgtgactgtacctggaggggacaggagagggagggacaaaggttctaggtagaggacacatagcatgatctctccaggtaaccccaagaggttcagtgtgctcagagaagagatgggtagactcataaaaacaggaatggaggcagtggccaaaccaagaataagggtagcctccaaggaacctggaatagatcttaaggggagggggattggcagagtcagggaaaggtgctgatggccaagaagtgagggctcaccaacatcagacacgatagatccaatctggctccttcaaaggcagctccatactgcaagttgctgtgttgcacgacgacaaactcctgagcagacaggactagctctgtaggcagggaccatcagatgctggagggactcacccagggcctgcatgaacactggctgactgggatgctaagaaggggagtcaggttctggaccagggctggaccaaatgacctttcaagttccttccaaatctgagcttccaggattctaaagcaagcccggtagctgaactggtgccatgagctgggatctgtggctggggagctaccctgggcagcaaatgggttaaagctcaaataacttttatatatgaattaatgtgtagagttgggagccaaaatctgttccattaatttttccatccattccaggagcagttaggtacacacagtaaagtttattttggtgcatggtatacttcactccattaaaaataaattaatcagcaaattcctgcctggctcagctctggtttatgtaaatagtgcccagctgtaatgagttacaaggtgttattatctcacacacacacaggaggcttcactctagagctccgctcgcaacaaaagcatcttaaataaactgagagaagcggtttgatttgtaatgttttcacagaagtgggatatacctcacccatatagagtttctttatatgactcattttatagcaagttaaatgaaggaagtttgatgggggagggaggggcaatatggttccccaccccctttcttcactttaagaaaatcccccaagagatgacccgcactgagggaggaggggctggtcctcaggtgctcagaccaaggtggctctgcagcacgtgcttcagaagttgggaagggggaccaaagctgggcacaggtctgggtctgctacaactaagccaggaggaatgttctcttctccccagtatctcatgaaaggggaggccaagacaggagacagcatgttcctcattcagttcactgggagtgacaaaggtgactttgttctcaaggcctccttccaaatgacttaggatgtgaaagcccttggtcatcagaggcctcctgggtcccagacgacaggcctggctggctgtatcttggcctgaacagagacacatctccatgaactagaggcaagagcagcagagaccatcccagcctcttccctttctccgtctctaactgagctgcgcggtgccctcattactgcgtccaccatctcaggcaagtttctaagtccctggaataaagaagggccatggcagagagaagtctctgtttcttttaatggccaactcaaccccatggctgaaagccgagggacaacgcgtggtcaccgaccggactcggcagcattacaatctgctcctaggccacagcaggccctggggggtttcccttttgaacctacaccatcccttccttggcctttgggaaaagctatcagtcacatgtagttgctggagggggttggggagtgtgtgctgggggactctcactcggggcttcccctaagggagaggacaccccgggagagctaggggttctcccagccctgtaccccagcagatcagactcctgggcacactaagaggaaactcaacacaaatggggccaggtatttgacagatgctgttcagaggtcagttcaggccactttctgcagggtcctggaccaacaggcacttctctcctggaggttcctcgaagccagctggcgggccgtgcggagggcccagcccatcaaagtccctcgtcgttgtaagtcggagaatggggcttcaggatgctctgaggattcttctccactagagggcgccagctcacctcccctgtcagaagcagatcctccccgttcatggagtccaggtactgtatctgcaaccaggggagggggaaggaggaagcgacagaggcagggcagaggtgaggagccagcgtcaggaaccagcctcccagaggagaggaaggaaggggacggggcatgaggggggcttctgaccatcccaggtcccagaccaagccgtcccaggccaagccgtctctgatctcctagataatttcactaaggtggttcagagaaagcagtcactggggagctgggtggcgggggcagttagggaattccctatcacacctctgaatggagacagacacacacctcccaaggacacgtctcccctacacgccctccctagacagctcctgcaggccaggaagtcagggcttgcagcgcacacagccatgctgtccaccccagcactgctgggtgagagtcctgattctgtcccttcccagtgctgctacccagggtggcagcttcccctctctgagatttaagttcccttgtcttgagagaggggatagaaacaggtacctcacaggacacatgaagagattcaacaatatgcatatatgcagtgctaggcactcacgctttaaacatatgtatgcctctgttgtcctctagtgggcccctggtcagtgggccccagtatcacctctctaggacagtaggggcagacagctctgccattaaaatggtcatcatccagagaagccactgctgcagggccaggagacttcatcttaggctttaggtcattcccccttccaagaatccaccactctggttgcttccgcttccagctgctgacgcttgaactcaaccccagcctctcgcacgtgtcttggctctggattcccacctgccctgccatctcttccctaaagcccactcctcccttacagtgactccatttctgcccccagtgccacccctctgcccacctcctgggttgaaaatctcaacagaacctctggttggctcttgggccatcggccacaccaaacagtctgctcaaggcccagctcctgctcttcctttcccggccttcagcactctgccctccctgtatcacataacaggctggcttactccagggttagccgtgtgcctgggcttcctcaccaaaccatgagctggctcctcgagggcaggactgggtcttattaatcgttgctttcccaagagtacatggagcagcaggtgctcaaaaggtttgctgatagaactgggtccccaccaaagctccctgctttcccaagaaccccttcacggtttttccactgcctctcactggggccacatgggacctcttgtagggacaatggttgtggcagccccttcctagagggccctcggagaagtcccagtgtgtcttgttggggcttctggcacaagcccaccatggcagatggaaatgttgggcaggtctctcagaaaacacagcatttgctttgcgaattgctactcccgtctgagggtgagtccagtcaacagagtatcagaattctctgtgagtggggccctctggccatgccgtgccctctccctggctctagcagatttgaagagtggtcaaacagaagtcctggctcctgggattctctaccctgtgggtctgcagagccccagtatgtggtttttccagcagttaacaagctagtcctatgggccctgtcttctcaagagctgaagtccagccttgcctttcctggttgttgaagaccatgaatacaagtgaacaagagagtaactgtggcgtgacaccccttcagctccaggggccaggccatgaagcaaaggtgtgactcatggcacagcctgagctgtctgaggcagctgaggcctcagtggtcacatgaatcacacagcttggggccctagggcagctgtgcaggctgactcactgggaggccctggaagagcctctatgtcctcttcgctgccagtcagctcactcatctatcaagtatgagtttcccatcaatacaggatctgagggcagggaggtcaaggaattaattccccggggcttgaggacagctatgtgggtaagcagcccccactgcggagctttctcgtagaagctttgatgtcggggagccctggggagccagaggggtgagaaactgaagtggggggactctacttgactgtggagagcatctagcaggaagaggctgtctgtgaaatgctgcctgctgcccagttttgctggaagtcaggagcaggaaacaaatccaagtgggtagagaaggggtccacagtgggcagctgctactacaccacgtgctcatatctgccaggactctgtgggcccagctgctagcatagcactgggcgcacagtaggcaatgaggtgcacagtgaatgaatgactcaaagttcctgagggcaggagactactcgatgcctctttctctctctcttcccatttcccgctccctggcccagttcatggttggacatacagaaggcgctccttcttcagcgtctagtgctgatgtgatctggtcagaattctctcaggctggtccttggtaactccacctctcatgatcccctgaaagcccaagaggaggacccactgttgccaggacttgggaggggagggaaagggtcactcacctgtttcctcacatactctaccagcaattcaagatgtcgagggtcttcacatttccggttgaagaaggttctccagagggcagcggccagcccatgatcatctgaaaggatcccctggaacatacagcacagcagtggtctcctgagggatccacagagccaggacacagacggtggggatactatgaacatgctagcaaccatggaatcagctcagaagggccctccacgcacaagaggaaaatggggcagtcacacagtagaggtggaaggggtcttacaagggtatctggcccaatcccttcattttattacatacagagggagaacagggggtccagaggggccaagccaccagttaggtgatgcagagctgggactcaggcagtactccgtactgcgcctggcccaggcaacacttgagaggctgagaagagaaacagtagcagcaatgctccccctgctgtccatagcagcaatgctccccctgctgtccacagggcacgggctgggaatattgtgaatgtatgtttctcccaggaatggaggtgggcatggactgtgccttcttgcttggtccaaggaccaaggcaaggcaactggtccttgggggaagggagccagctaccttgtcttcactcttacccaactctgggcccagcctctccctaagtaggggaacaggatgttcagcaggattgctggggccacagagggccaggctcagagcttgcatgtgtgtgtgtgcctaacgctgcctcttttggcagaggagacttctgttgggaagcttaaagattacagagcaaaataagagccccagccaccagctaaggacattttctagcttggacctctagaggagggagggctgagagtcttgcttcctggggtgaaggtggctgatggaacaggccctgagaagttgctctgtccaggtgccaaggtagtgtgtggaatcgatgtgctgacttggagttagaagggagatcaagtcctaattccacctctgccaagatcagtgatggtggcagctgactaaaccaaagtctcaatcttctacttcttcaaaacagatgaagttacctgctctacttatagcattcttgaactatttgttaagtgtaatctgttggatacaaagattaggagcatgctttggcagacagcggggatacagtcaaaaccgtggggtctgggagccagagcacagagttcgaatgccagctgtgtcacttgatggccatgcggcctttaagaagctattagccattcctgagcctcagtttttcatgagtcaaacaagcctaataatacctatcccacagagttgctgtgagaattaagagatactggccatgaatggctctgtaagtggtaaacattacccaaagacccaggatcactttattcgacattttattgtggtctgtcctcttgggcattgtggtatgtgaggtctggctccaggcctgctgccaacaagggccatgtccagtatggggtgctgacagtttggtagaaaaacattccacctgttccaaatgctctctgataaaccctccttacggttccacagcttaggactgtcctggcacaatggctgagtcaggaaaactggctttttctggcacatggggacaggagcagaggacaagctcaggcacatcacccttctgcaaacgatttgctagcacaacagcgtgcctgtgtctgctgtgcctgggcacatgccagagcgctgctggcagcaacccacatgtgctgtgcagaaaggaatgggattgggagcgcgtgttatggggacctggagaatgggcagagcccaggatgggaaaacaggcaactttagcagcgggtgagatggctgggaaggggcaaattcataatcaggaattcctgagccatcagaaggaaaaggatgactcaggacccactaatagtgagaacaacccaactgtttcagactgttagggttccctcacacgcctagctcctaatgattatgtttgccaagtagaatagatattatattcccatttgctttgctttgttttgttttgttttgagatgaagtctcactctgtcacccaggctgaagtgcagtggcatgatcttggctcaatgcaacctctgcctcccaagttcaagtgattctcttgcctcagcctcccaagtagctgggactacgggcatgtgccatcacacccggctaattttttgtatttttagtagagacagggtttcaccatgttggccagggtggtctcgaactcctgacctcaagtgatctgcctgcttcggcctcccaagtgctgggattacaggcgtgagccaccgcacctggcctatatccccatttgaaagataagtaaactgaggcttagaggctagctaactgatggctgaactagaaccagcatgcattgatgaggtgggggatgatgactgacccactctagtcagaatacagaacctggcatagagtgggagagcaatcagaatggctgaatacccagcactttgggagtccaagctgggtggatcacttgagcccaggagttcaagaccagcctggacaacatggcgaaactgtttccacaaaaaaatataaaaattagccaggcatggtggcacacaagtgtagtcccagctactcgggaggatgaggtgggatgatcacctgggcctggggaggttgaggatacagtgagctgtgatcacactgctgcactccagcctgggcaacagagtgagaccctgtcttaggaaaaaaaaaaagaatagctgaataaatcaacgaacacaacttcagccttcttcccaccacactgctagtgtaaggcagtgaaaacaaatgagagactaatctgagggtgcacatttcaaactaagaaagcagaactggaagaagggtcctgggaaccaaacatgagggcacagcataatttccccccaatctaatcgggtgcctacttgttttccctcgtgacacaatgaagcatccttcagaaattaagacacctaggtctagagtaactgagaggaagccaaggggattgtttcagctttggagggttctagttctgattaagggtttaaagtggcagagttccactcagtgaagattgatttgacatcactatgtgctcagcatgatgctaggaacacaagagtcacagcaatatggtctgagctctcagggaacttgcaatctagctgaagggacaaaatcagtgcacatctaacagcagcacagagtaaaatcccggagaatgaacacatgccaagctgcacagtgagactcagctacactctacatggctgcctccttgttctacagtcttagcttttatgacaactcctcagagagatcttcctggtccacatcaagtcattccccctgttgttctctctcactgcactctactgtagttagatatttactgcttatctgctacttgtttactatgtctctcaattagaaggtaagctctagtgggaaagagccagaccgtgtttgttttattcaccaatatattcccatgtatcacacatggtagacactcaaaagctacctgttaaatggataatgaatagatggatgggtgtggaaattcacagtaaaaacacaagcgatccagagaggtcagggaaacctttctgaagaagtaggcctttaagaattgggaggatttagcgggtgtggtggctcacgcctgtaatcccagcactttgggaggccgaggtgggtggatcacgaggtcaagagatcgagaccatcctgggcaacgtggtgaaaccctgtctctacgaaaaatacaaaaaaaattagtcaagcatggtggcgcctgcctctagtcccagctactcaggaggctgaggcaggagaatcccttaaacccgggaggtggaggttgcagtaagctgagattgtgccactgcactccagcctggcaacagagtgagactctgtctcaaaaaaaaaaaaaaaaaaaaaaaattgggaagatttggaaagctgcagatttttttttttttttttgagatggagtctcgctctgtcacccaggctggagtgcagtagcgtgatctcagctcactgcaagctccacctcctgggttcatgccattctcctgcctcagcctcccgagtagctgggactacaggcgcccaccaccatgccgggctaatttttttttttttttttttcagtagagacggggtttcaccatgttggtcaggctggtctcgaactcttggcctcgtgatctatccacctcggcctcccaaagtgctgggattacaggcgtgagccactgtgcctggccagctgcagattattctaagcaagagaaaatattcaaaatatttacagagggagtgcctacaaggtacaccaggccctgaaccagaccctaaagctgaccaagactcagctactgccctcaacccctcattgttaggtagagtctcagtcaggcacagcatgtctatagggcagtaaggcaaacggcctaagagagagcacaagaaatataaaggcagatagggcacatagcaatggcaacagttcacagaaggcctggaagttcagggagcaatttggacctaatgtcacagaaaacagggaggttcccaaagcgtccagggagggggaacaatccaagcaagattctaggaaaaggttgctgtagaacagcgctgtccaatagaactttttgtgactatggaactgttctgtatctgcactgtccaagatggtagtcacatatagtaactgagtacctgaggatctgaattttccattttatttaattaatttaaattaaaatagctgcatgtgtttagtatcaaatagctctagcaccttgtgactccaagtgtggtctgcaaaatggctgcacccccatcacgtgcagctgttagcaatgcagaatctcaggccccgccccagacttgctgagtcagaatctgaattgtacctaggtcctctaggtgactcacatgcacattaaaatacaggaaaaacttctagaattgcacattaaaatcacctgggaacttttacaactacagatgtccacctccaccaattaaatcagaatctttgggggacagggcccagacactgatatttctaaaaagtgtcccaggtaattagtatatttccccaaaatttcctgctcttaaaagtcaccttcgggtgacttgttgaaccaccaggcagcactcctactgaattgtaatcttcagagaggtgataaagatttagattttaaaagcaccccaggtgactcctgtggtcaggcacagttgggtaaaatggctctgccagaatggactggatgggggaccggaaacaaacacaattcggtacatttttattaatactgatgaaaggatcgactgagccaatagagccacctgcaataaagaccataaacaaaggctcacagagaggtgtagttcttcactcctaagcctcatccttttctatattgtaaggcttctacaattacaattcgtccacttttataattgatatgtacacttgagcaataattctcaattcccaacccataacccccgaaagctcatgttaagttaatgatgtgtatagtatgcaatgtaaatgctcccttgtaattcaggatatccagtagaataggaatcaggagaccctattttaacaaaagttaagaaactgaactccagtttcttaacttttgtccttttatgcatttctcactctttgactaccacatgccaagcactatgccaggccacagaaatgcaaacacagtaggcattgcactacccaaaaagaaatccccacccagccaaggtgacagataatgtgaatgtagtaagcactgtgagagtgcagggaggatggaatgagctgagtcacaggaagttcaggaaccgcttcccaggaggggtcatgcttgcattaaatctggaggtaaccacaaaatcagtataaaagcatatggttagtttaaaatatcaggtgttcattacaccattctttctacatgcttgaaatctccacaataaatgttggggagaaaaaagatgagatagatgaacctcgagggcattatgttaagtgaaataagtcagtcacaaaaggtcaaaaattgtgtgattctacttatatgaattatctacagtagtcaaattcatagagacataaagtcaaatgaatggtggttgctaggggatatgagggaaggagggaataattattgttcaatagggacagagtttcagtttggaagatggaaaagctctggagatgaatggtggtgacggtgcaaagcaatgggaatgtactttatgctactaaactgtacacttaaaaatagttaaaatggtacattttatgatatgtatattttacaatttttttaaaaagatgaggccaggcgtggtggctcacgcctgtaatcccagcactttgggaggccgaggcgggcagatcacaaggtcaggagatcgagaccatcctggctaacacggtgaaaccctgtctctactaaaaatacaaaaaattagccgggtgtggtggcaggcgcctgtagtcccagctactcaggaggctgaggcagaagaatggcgtgaacctgggaggtggagcttgtggtaagtagagatcgcgccactgcactccagcctgggtgacagagcaagactctgtctaaaaaaaaaaaaaaaaaaaaaaaaagatgagatagatccaaatgtcctgatgtggaaggacacccaagatacatacttcagtgaaaaaagcaagttgcagaatcatgtgtctagtgtaactccagttgcataaagaaggaaaagacaaaggtgcttgtctatgcacagacaacattcggaaggacatccaataaactagaaattaagttttcgtctggagcagggtaggaaataggtcttctaatttcattttttttgagaccaagtctcattctgttgcccaggctggagtgcagtggcgcaatctcagctcactgcagtctccgcctcccaggttcaagagactccgcctctcatgcctcaccttcccaagcaggtgggattacaggcacatgccaccatgcctggctaatttttgtatctgtagtagagacggggtttcaggctgatctcaaactcctgacctcagctgatccacccacctcggcctcccaaggtgctgggattacaggcgtgagccactatgcctggccaggtcttctgatttctatttcaaccacttatgtacagctttacaaacttttatttttatttatttatctttttttgagacggagtctcactctgtcacccaggctagagtgcagaggcatgatctcggctcactgcaacctccgtctcccaggttcaagcgattcacctgcctcagcctctagagtagctgggattacaggcacccaccaccatacccggctaagttttgcatttttagtgacacggggtttcaccatgttggccaggctggtctcgaactcctgacctcaagtgatctgcccacctcagcctcccaaagtgctgggagccactgcgcccagccagttttacaaactttcaaaatgaatatgtattgctttcataattaaagcaaaaaaaaaaaaaagtgtatactttgcctggcagaccatgctgtttacgtgaatatcctcctctctctgggagcacatggggctaagacagtgtctcatttgcctctgtccctccatccagcacccagcagccactcaacaaatgctgactagttgaatggtttgaccatattatatactgctttctttcccaaacatgtggcatgtttcccaaacatgctcagcacattcattctcgctgcccagttgatgaatatgaagaaataaatactacgccatggtggtagccagtaacaatggtccctgtggcttccctcagaggctctcatcaaaagcctttgctgggggaggccaccgtcctgcctaagccttggcaaacaatcttacctcatcatatcccaagatcgctgcatagaaatgatttgtcatgaggatcatgttcttcttcaggatatagggattaacctacagaaacaaatggcaaaaacaaaagtttgaaagaaagaaagaaaaaaacccaaaaagtatgatctttgactcttagctgtcacagactcttagtagaagagagacggccactaacaagtcaagctgccagtccattctcaattccctgatgtgtcaggattctccccaatttgccaaattcttttaggttttgatctcaaattacacaagtcagcttaatgaactgagccccaaccacatgtttagttttgtgctagatcctatgaaccaagtataagaaacagtttcttgattggaggagcacagtccaatgtaggaaaataggcatataaaaaataattatactgcaacatgttgcctcaaatcctattctaaacatgctgagtgataaatgggttttagttttacctgcttgagggagctggtaagggctctctaggaggtaacatttaagtgaaacttggaggaggaggagtttgacagaggagagtgagggggaggagggagagagagcattctagacagagcaaggtgtgcaaaggtgcagaggctggaaagaaaatggcgcagggagggtgtcagggagggtgaataggcaggatcacaagaaagttatgttgagactaggttaggagacatcttaagggccactcaaaagagtttgtcgtgatgaaaaaacagagaaggaagtggtcagaggtgggaagaggagggagagaggcaggactctgagagacatgctgaggaaaaaggggggcctctgaggccatggaaaggagggaagaacaaagcaggggcagctctgaagcaagaagaatgttaaagttaagagatcattttggctgggcagtggttcatgcctgtaatcccagcactttgggaggccaaggcaggcagatcgcttgagcccaggagtttgagaccagcctgggcaacatggcgaaaccccatccctacaaaaaaatacaaaaattagcctggcatagtggtgcatgactgtagtcccggctacttgggaggctgaggtgcatcacttgagcctgggaggccgaggctgcagtgagccaggatcgcgccactgcactccagcctgggcaacagaacaagagcctgtctcaaacaaacaaaaactcagagactgttttagaaatgcaattctggtgagatggttgagagcccagtagaactcctctctcctcttggggaacagcctggcctggaggatcttcagggcccagagtgcagttcgctgaatgccttcaatagggtacaactctgacctccagacagtaacacgctgtaaggcagggtccacgttttattcctcttcaggatcccagcagaaagccagtgcaatgtatagcacagagtaaggactctgactatctgaactgatggttttggaaatagccaaaaggcatttggaactttatgtggagaacaagatttgtgcttaacaactctgacggtgaccatgcccacagtcatctcatttacgaagcacctgtcatgggctgggaggtagatgtgttacagtcactcagactgtaagtgactgtgtgagagactcagactggtgaagtgatgccttgtgtcacacagcaaattcatgataaagctgagatcagcatccaggtcagtctgaatccagagtccacactccttacagtctgccagggttctgcttctgggaggataattttactttgggtcacaaatcaaagactgagtgattttatcctgtggctcataactagtctcggaagaaatgtagaaagggtgatctggatttagactcagaaaacctgggttcaagtgatagttttgctatgtacacaggatgttatcttaagcaagtcaacctgagtccatttcctttttcttttttgagacagagtctcgctctgtcacccaggctggagagcagtggtgtgatcttggctcacggcaacctccgcctcccgggttcacagcattctcctgcctcagcctcccaagtagctgggactacaggtgcccgccaccatgcccagctaattttttctatttttagtacagacggggtttcaccgtgttagccaggatggtctcgatctcctgacctcgtgatccacccgcctcggcctcctaaagtgctgggattacaggcatgagccaccacgcccggcccatttcctttttttttgagacagagtctcgctctcttggccaggctgtagtgcagcggcatgatctcagctcactgcaatctccgcctcccgggttcaggcgattctcctgcctcagcctcccgagcagctgggattacaggcacctgccaccacacctggctaatttttttgtatttttagtagagatggggtttcaccatgttggccaggctggtctcgaactcctgacctcaggcgatcagcccgcctcgacctcctaaagtgctgggattacaggcgtgagccactgcgcccggcccctttcctacacacagggctatttggaagagcacgtgagttagcatgcattcattcattaatttaataatgtatgtatgctgaaagccttggtaaactgcagaatgctctgcaaatgtaaggaattataagtaataacttctggtttgtttacataaaaccaaaaccagttccaatgctttacagccatggataattttcaaaaatgaaaggattgtgaagctcaaggctggaaaatgtagactggatgtaactaggagtgcaaaccatgacctatcccacacaccttcaaccagggctacattagccatccatccttggtgttctcacagctctctgggcatattttctgcctgggtacacacgtggtttagagctgcttatgcacctgtctctcccattagtctgggagctactcaagggtcataggaaccatgtctgattaatctcggcacccccatcatctggtccagagcctaacccagagcaggggctaagacaggcttgctggtaactgaatttttacaagggcctgtgtactacgccatgcatagcatgttctatccaactagtgttttaggggattttcttcttcttcgcctttctttccccctgttgaataccttctgtgtttctggaatttcagaaacatatactgccaaacttctactgtcccatcttccagaaaggggtaaagggaagagtcaagaaacaggccagagctagagttcattccttctgtcatgtgaggatgagactacaactcagacctcctgatacccatacttggaggatctccctactcccacatgagttgttctcctaattgtgttaggaataatcacagccacaaacggatgatatcagaggtgtcaaacagtaaggcaggagcatctctcagaggaaaacattcactgaacctgcctagcagagctagtttatgtcatgtatcacaccattaagctttggagcaggaagggccctcagagattacctagctcaatacccttgaggaaagggtgaactgaaacccagaaagaagagacttattcaagatcacacatcaagttagtataagagccaggattagaacctgatttctgggtaagtgcttttcctactttaccatctgcagggcatttccagagatcatcaacacattcatctgcaaacctcagttcttgctttccagcaaggcccacaaacatacaaacacattttctcctcttgggatacacctgcattctggttggctactgcccaggaaaaacggagtgcaagagtagagttccttactagcaaggctccttgacttcctggtcctatattctaactccagtgacctgtaagctgcctctcccttcacctctagctgagacaatggcaaactgccacagctagaaatgcttttcagatatcatcacccaggctggattagatcatgaaaaggggccttcctggaagagggtggaagtgagatcagtacagacacgtgatctgcaggcaacaggtgagggcaagtgacagcaccttcctcaactaccggactcactcggcagggcccttctagctagtccagcagccaaggggagcaggatattcgctctggtgaatccctgttggattttattccctcatttaagtttttggttgctggtgtgcaggttccccacctctccactgccagatcattctatatggagcactctgcccatgactacacagctgcacccagcagaagagaaactcctcccagatagtgttgggccgttctcttattaaactcatcctttccataatgctttgcttttcataaaaacccatacatacaacaccacaaggaaaaggttccttttatatcagttactcatattttcccatttatttaagccattaaaattcatgcagatattttataagccaccaggattcagtgactggtattactgaatgtttaataataaactaaacagaagaaatcagagggttaaatgatgactgcaattcctgtaatgacttaattaaatttttattgagtacataaactatgatgtcacctctagccaaccacaggcctgctttcccagcatgtcacagggagggagcactcaataggaggcttggctaaatgagcagcaggtctcagctgaaatggggaggggagtgaggctcatgtaacacactcaataaattatccgttcatttttaaacaaagtccatgagttataatatatttgccatgcactttttatgacataataaaaatgttaccttaaggattacttaacacatactacaaatattatagcagaggcaggcacaaggggcaaagaaaacaaacacgagcaggccagggacgggtcctggagtttatgtcccaggggaaacagcatagtatattaaaaagggaatgcaaaaaaaaggaagggatgcaagagttcagggttactaatcggcagattaatgaatgagacaaccaacagagaacacaagtaaggcaataatgaatcttgcagggcacatgtttaattaaagtagcattctcaaggaggaatattagctttaaagagatgccagttcatttgaggccaattcgctgctctctttccccttttcactgttgctgccttaaagatatttatgtgactgcttaacagaggaaccagactatgtggatacagggactgatgggagatcaagttttaactcctccatggactctacaaggcttctagtgatctgctcttggccatcttttttgcctcccctcctcttgcctccccatcttacttcaccctgcagtcagtaaagtatgtgcacagatacatcatgctgtcatctatttcttagtcatactgctgccaggaattcttctcttctttatccactgatggaagggatgctaactccttatcctctaagacttagcacacatattttctctactaagtctgccctctcccccatctacaggtgccccaaagtgattcaagtctggagacgggtcccatcattcattatttaccaagtgccaataactgtgctacaactttacacattagcccacttaaaccttcccaaggactctaagagacaggaactgttactgtctccactttagagaagaggaatctgatgtttgggaaagttaaagctagacagctaggaaatagtggggtcaagataagaatacagagcaatccaactccattgcctacctgtgttggaatagacactggaaggaatgtagctgccccttcctgtgccccacagctcaggctatctgcagaggcagaactaagaaatgctaatgtggtcttgagtaaacacaactcagagattccagttccagtggcagctagagacagccaccagatgggtcatcagtggccggttactaatacatcagatatccctagtagagccaagctccactcctgggaaaacctgaggttgagagtgggtgtaattatggtgggggaatgggaaaacagaagaaagttggtatggaaaacactgatgagcatgaaggtgagaataagctttaaggttactggcttgaagcaaagttgctaacagtagcagactaagaatttgctggaatgaatgaatgacaaaggacagctagagttgctggctgaagcctaaggactatatcaaattcatcataaggcaacaatgcaacacaagattgtaggtcatgttttagtttgctgtagtagacagtaatgccaccaccaatgctttgcagtgccaacgccatgttctacagtcattgtgcggcaacaggctgatgtgcactgaacatcagctagcctatttaaagttcaggttagaaattagcccactgtggaatattttgtgagatacttagaaacagagtaagagtagacagacaagagagacgggggacatggagagaccaaataaaaaagtctacctgttaactcacatgcattacgactgaaagatctattgagggtcttttagcaatgatgacaaaatacaaacaaaactgtgtgtgtgtgtgtgtgtgtgtgtgtgtgtgcgcgcgcgcgcgcgcacgctcaggcacgcatgcatattgagcagttccagaaaaagttgttaataccaagaataaaaagaaaaatattttaaatgaaagacaatttctttttctctttttagaaaataatgtgaacatttaaatagagtatgttcccgttgcgatgaaaggccaacctaaacccagcatgaggaggtccattttaaaatccattttaaacatttcaaacttttaatgtacaagggaagcttgctatgatgacatgctgtttaaaaatattcccttattggctgggcaaggtggcttacgtgtataatccccatgctttgtgaggccaaggcaggtggatcacttgaggccaggagttcaagactagcctggacaaaaaagtgaggtcctgtctctacaacatagtaataataatacaaacccctttcttatttattttgaaaattctagttttgctgcttgggatctacatgttcaagactgcatagcctgataatgtgctgaaaaacaagggacatggttggcagacagaattgcagaaccagcagccctaatttctatatagtcacgaagtacaggagtccttccctcaggcttggaaaatagccaagagagaagagatgtatgtcctcagaaattctagtcatttgtccagttgagaaaacatgagaacacataatattaagtccacaatcatcttcaaaaggagctgatgaggtacactacggttctgggatgatcaaactaccatggcaatttaactttcgtctcttttagggcatttgaataaggggaacattatagctataatctactttggtttctggaagctttttgtagtattccacatgacaagtctcatgcatactcattagagaagccaacacctggcttgaaagagtcgcagtttcaacaacagcactgatggtgcggagtcctaaaggaaataatcctgggtactatctaaaatccgtactgataataatgatgacagtgatggtcgtaacaatgattacacaatgcatttaataatattttcattttattatcttatttgtgcctcacaaccacaaccctgccctcgaggagctcacagccaaaatgctattgttgtcctgattctataaacaaggaaacagaagctcaaaactgttaagtggccaggtgcggtggctcacgcctgtaatctcagcactctgggaggctgaggtgggccgataacctgaggtcgggagttcgagaccagcctggccaacatagtgaaaccccatgtctactaaaatacaaaaaattagctgggcatagtggcgcatacctgtagtcccagctactcaggaggctgaggcgggggaaccattgaacccgagaggcagaagttgcagtgagccaagattgtgccactgcactccagcctggcaactgagcaagactctgtctcaaaaaacaaaaacaaaaacaaaaacaaaaacgttaagtcacttgtagtcaaatcacatcctgcttgtaagtgacagtgctgggacttttaactcagatggtcagtctctaaatctactgtcttttcttttttttgagacggagtcttgctctgtcacccaggctggagtgcagtgggaccatctcggctcactgcaagctccgcctcccgggttcacgccattctcctgcctcagcctcctgagtagctgggactacaggcgcctaccaccatgcccggctaattttttgtatttttagtagagacggggtttcaccgtgttagccagcatggtcttgacctcctgaccttgtgatccgcctgcctcagcctcccaaagtgctgggattgcaggcgtgagccaccgcgcccggccccaatctactgtcttttctaagcgatcacacctttctgcttctgatgagtcatatgagaaatggaagaatcacacaagcacaaagctaaaattgctcatttctgcactttggaaagcaagagtaaaatagactctttttaaatttagaaaaactgtccttaaaaagaagatgagattcgacaaggtcaaatgcacagtattatgtctatatcaaaataaaaaaataacaggatgaagcaagggtctgaccaagtagatgtaatagcatcccagagcaaatctttctcatgaacagataaatcagaaatatgaaaaggtaattattattatctatattaaaggaaaagccatatgcaaaggtcaaaaagttttctcccctcatttattttaatagtcaaaagtctttgtcttaccaaccgtacttaagaatgaacatggagaaaccagagaggtttcaagaaagaatgtcagatatatatggttacaatgggttggcactggtcacaggccagggcgttcaagattctatggccaagagaaacacccagaggctattccatggattggtcaggttgcctccatcatctgcctcaatgggtcagtagatcttagaagtactgtgacactgaggtttctctctctgcatttcttccttatgttcaggacctactctttcccatttccacgagttggcaggctgttgatcctagaatgctgtcctctcatcacagagatgggcacatagctgaagcttagctaatctgactcttgcttctgagagtacaaacaaccaaatataaaaggaagctacagttggatcacccttggcagggcacagtggctcatgcctgtaatcctagcactttggaaggccatggcaggagaactgcttgaggccaagaattaaagaccaacctggccaacacagcaagacctcatttctaaaaaataaataaataaaatagtaaagttgggtcaccccaaagagactatacataagttcctattgctaagatcccttagctgccctgtatctttccttcctgagctctgttgttaaactctccattccatgagccttagttaccttccaataaatcctttgtttgcttaaattagctaaagtcagcctcccaagtagctgggattacaggcacgcaccaccacacccagctaatttttttttctttttctttttgagacgcagtcttgcactcttgcccaggctggagtgccgtggcgccatctctgctcactgcaagctctgcctcccaggttcacgccattctcctgcctcagcctccagagtagctgggactacaggtgcccaccaccacgcccagctaatttgttgtatttttagtagagacggggtttcaccgtgttagccaggatggtctcgatctcctgaccttgtgatctgcccgccttggcctcccaaagtgctgggattacaggcgtgagccaccgcacctggccgagcaagataattccatttacacccactaggatggctataatttaaaaagaaaagaaaaataagtattggcaaggatgtagaaaaactgaaaccctcatgcattgttgaagaaaatgtaaaatggtacagccactgtggaaaacagtttggcggtttctcaaaaggctgaacatagaactaccatatagcccagcaatcccattcctaactatatgtccaaaagaattgaaagcgggaattggaactgatatatttgtacaccaattttcatagtagtatcatttatgatagccaaaaggtggaaacaacccaagtgtccaatgacagggataaacaaaatgtggtacacacataccaagggatattattcagccataaaaaggcataaaattttgatatatgctataacatggatggaccttaaaaatgcactcataaatgcattatgcttaatgaaataagtcagacatggaaggacaaatattgtataatttgatttatatgaggtacttaggtaccttcagagacagaaagaagaatagtctacctggggctgatgggaggaagaaagggaaaattattatttaatgggcacagagtttttgttggggataatgaaaatgttttgggtatagataatgaaaattgttacacaacactgtgaatgtacttaatgccactgaattgagcatttatgaatggttaaaatgataaatattatgtatgtatattttaccacaataaaggaaatcccagttacaaacagttcttctcagacaggcatttcaatctgtgacttaaccatgtgtgtattaaagcctctcttaggacacttatccatttggcacagtggtatcatgagctaactgatgttcctcaccagactataaacggtcttggtacagaattctacgttgcattgtacatgtttgataagcacgtattgagtaactgctgtattctactgtggtatatgctggaggtaaaaaaatcaataaaacacagtacttgtcctcaagaagtttacaatctcacgtgggagacacacctagcacgttgtatgtacaaaacggtaatggtatagggactgaaaggcttgagagaagaggcaacatttattacagtgggtattaaagggtcaacaggtatgttcagacagaaagaatggtatgtgtaaaggcacagggaggtgaacaagtacagcattttcaaagggaagtttgtaaaaaaaaaaacaaaaaaacacacacaaaaaaaacaaaaaaacacagaagctgctcatggtggcaagaatcagaaggtggagctggaagggcagtttgtgtgagattgtaaatggccctgaacgccagccacatgaaagaaagaacaaggaaggggtttaagcacagggaaattgcatggacagatttattttcaaaaagtaaccctagaagtacagatcacaaagttgggggaaggtccagaggcaggaaaaccagaggaggctgctacaatggtgtagatgagagtctgtaaggaactgaaacaatgtgaagtgacaacacgaacaaagaggaaggcatgctttcaagagaaatgactacagccagagcaacgggatttgattatcgagtagatgaggaggaggaaaggggaggccatgacttgcatgtaatcagacctcactgaagaaagtggagagaacagaaagatgaaaacggaatgcaagttatatgcaatcatacactgatgactttctgaccctggcagtgccaagcgcagacaaccagtcttgtatgattttagcaatcaccatgcccttcatgtctcctatgttgtggtaatggaaaatcttacttggataagatgtaatatgagcaagatgtgtatttagtttgagcccggcaggcgtctccagtggagcacaggcataacacaccagggcctaggagcctgagccccttttccagtaatttgttcactacatgtaggtcggtatcattactccgggccctctgcattctgactgcagccatgaggtctgattaccgtcagcaagaagacgctgacacactcaggtttccagagacacttggaggctgctaattgcaccctgagcctcatgactgcatttatgagcgcagaaaagctgcaggcactacttggcttttttaattattttctattaaatttaggcagactgggtacagtggaaaactacaggatgcttgttccacatcactaccaaccatgtcaactgcacagacacaaaaggcaaacaggtgaatatagatcaacaagttggtcagttctttgctaatagagctgagccactgtcacttgtcatggatgctgaggccctgaacaacctagaggatctaaaggcaacactgagatcactgacccgagtcctttcccagcgatcctaaaatagatatcatattgcccagatggcaacattttctcagaggacccaaaatttagccccttactgatcttgaggttcctgacccttcatccaacagccctgccttcttcttctccacagcaatgaagagtgaaaggggcggggtcaccctaatgaactgaatcacaggagttaactgctaactccacctgggcacaatgggtcagaccaaagtctaaagctcaaaacagtaaagcagacatttacattgtttcacacaggtcacagaatgtttgtctttcactgctgtgtcctaactgctcactgttcagagctgtacaattgccaaaatactgacccaatggttatctgagaaagaggctgttccctgctgaagacatgaggaagcaaaggctcagaaaggtcaagtgactcacccaattatcacttggctaataaatggtcaagaggttcacagagacaaggtcttctggctcctagtccaagtttttttgtttgttttaaggctcaaacagaattgccactcagtggatagtttgtacattcctgtagaagcatcctgggaatggctgagcctggatcccaggtagaagccatatgatcattcttacttaagtagtgaggtggtcaaggttgaggccaagagtgaggttcagatatcccttaaaatggaattgacagagccgggtgcagtggctcatgcctctgtaatcccaccactttgggaggttaaggcaggcagatcacctgaggtcaggagtttgagaccagcctggccaacatggtgaaaccccttctttactaaaaatacaaaaattagctgggcatggtggtgggtgcctgtagtcccagctactagggaggctgaggcaggagaattgcttgaaccaggaggcaaagattgcagtgaggtgagattacgccactgcaatccagccggggcaacagaacaagactttgtctcacaaaaaaaggaaaaaaaaaaaaaaaagcatggaactgacacagcctgtgagttctgagagtgactccatctttatagggtaattctcttttgtcctcttttctcagtaaaatgttcttagaaaggtattttatccaaaggaaagagacaaactcagttagaatgctgtatgttaaagagatgatctctttggtgttctgtatttaagtcccaactcagacctaggaaacgcactgaaatctaagtaaattttgggccccaacagccctgtttccccacctggtgagtctgaaagattaatcactctgagcctcagtttttccatcacaactatgcaaaaccacctttcctttttccttttcatattaacagatgaaaatgcctaacagtaagtaaattagtagtggcaaacatctatttcactctcaggcattgtttaaagaacctcacatgtgataactcatttatccctcacaatgctacaagcgatgtaaggtgggtattacagttatgtctattttacggagagaaaactgaggcatagaaaggaaacaggcatagagaccttgcccaaggtcacatggctagggcaggatttgagtccaaactggcttcagtatgtgagcactctcaactactctgtgatactgcattggaaaggaggttataaactcaacccaatcccccacttggagatgagagcctggaagtctctgaagcttctctcaggaccttggggctcacctactctcctgcctcatcctcccattacactcagccctgccctgggataactcctggaagaagcctgcagtgaacacaaaacaaaaaagcaagtgaactcatatctttctcgttcgtctgtttcgtgtggaagtgaatccaggaaagattcaacttcctttctcagcataaactagattgtaagccctgtaagatcacttatctctggtatattatctaccaaccacattcagggattagcatgtggcgagagacaaaaatgttccttgaataaatgaatgaaacaattcttaataaaaccatacaaattaataatgctactggatctagaggaaatacattcaatattgccttcatcaaatgtattcagcactacccaggcatcaagcactgttttaggagctgaggctacagcagtaaacaagagacaattcccgaactccgggagtttaggatgattagtcaggctgctgaatgatttgcagaatgaatctgagatgaagagagtcaagaggcaggaggaccagtgaagaagcagccgacagtgagtttaggtgagaggtcaggactggatctgagcatcagtaggacagttgaggccctgatagtggttgttttaaagaagggctccttatagttcctcctgctcctttgagaaccaggcacgtcacattgatggcaaggatcactgacattcagaaagaccagctaaagagaggacaatgaacatggaaaaacaagtccctccactctagctgggccccttcagctccaaccaaccccacagggccattcactcagcattttgggggaaacaaagtgagaaaagagtgttacagctgcctcatcaatggatccagaaatactcatggcacacccagggcagctgaaagaaacatctgtctctactgtatcctaggtctgacctcagagcctccagaacttttttacatagccccacccagatcctggcggagctactgccctctggtggtacccaatgcaggggttaagcccacaggagaaaagagtcttgtggtaggacatggagtgagaggcatagtcaaccccaagagctcgtcacagtgcctgtatgtcttactactgcaaccactgctttttccaaagacgctatttacagaaaactctggttaaaatgcaagagttatctgggaccattaaaacagatcctgttggcaacccttaacgatttggcatgaatttaatcaggtaaactgcagtgtaagtatagaattgattctaagaagatagggttaggaatagactctgtgagttcactcactcattcaccattcaaccaatattggatggaggcttaccatgtgctaagcactgtgctagacactggaatgctgaccttaagagaaaaggatcaggaggtctttgattggaggcttttcccagcaacacaaaatgcagggtgtgtgtagtggctctagagaacagcaaagatgatagtatcaagtaacgaaaagagcaacagaatcaatcaagagaagtgagttttagtctctgctactaccgctactatatgacactgaccaagcctttttcctgaccaggactgagtgtcctcacttggaaagggttgaattaggatcatctttgtggctgtcaagcttctaggagcttggcggccactgaaatgattaggagatggcataaaataaaaacactgactgcttggcaattctgaccagctagggctagccctgggtggggcttcctgccatcagccagggcaatctaaaattcctttacatagttcctgaggatcatcaccaagtgagattcttctgacatccatacccaaccacttcatcagacgagatacccctagtacgttatgaaccccacatttgtccccaactaccctagtctcttctggtccctttgaactgaggctattagggacggagccagttcttccagtgctacagggcaagagaggcttggagaaaagtagaaagttttgcaaactgtgttcactcttggaaattctaccctgggctggaaaatttttatctcatggattttttttcaagcaggaaaggcccttagaaataacctggtccaggctctgcattggagcctgctggttaattgtggaactaagtctaactccactcttgtagctccaagattggtgagtgtttttcagttctcccactgtccttctagagggaggctcttctctggcagccaactcaccttgggacctaaagcacaggagacgataaacaccttctgtctttgaaggagaaggagtatagccacaaacacctatcgaaaatgccaaagacaacaaggttcatttgaaatctgaagaatcttagcaaaacggtatgggacagggatgaaaagaagagcaggagacagaagcctgctcagcgcttaacaggaatcatctcctacttgccccataaccatacacataccacaagccagctgattcctaaccccagcagctaaactgcccaaggcctaggaaagggggcaacacacacagtttacaccttttattattctgatcaaaatttctctcctgggagcagaaaggggtcaaaagtccaacaccaaaaatatatatctttataagtcatgggcaaagaagtattacagcagacagttatttaaaaaaaaaaaaaaaagctacggtgaacagagcagagtaggaggtgtgagaaaactcactccaagtaatttattcactgggaaccacaaagggctttcccaagaacagcaaaaacaccattaatttctccagtaccctcctttcaaagggctccaaacacttcacacatatcgttttaaattgtcctcaaaggctccaaaataaggggttactatttccccaggcacagatggagaaactaaagcatttatgcccaccctgctctgcccaagtcatcctaaaagattcagccaacatcaactgagtgcctgctatgtgccttactcatgccaggcagaacaggagacggatgaaagataggatctttgtcctccagaaagccagaatccagtgtggtgtcacagatgcacctataaatcccttcaagatatgacagcttatgctaggtgctattgaaaatgtccaaatacagcatcctgatagctcccatttatcaagtacttaatatgtgccaaacactgtgctaagccatattgtttaagtcacataactgtgcgtgacttaccttatagaggatggaatggagacaatgagaggtaaagagacttgcctaggatctcaaagcaacattgtggcagagcagagattagaacctatgtctgtctggctccaaagaccacatgacaggaaaagaactgtttggaaaactgggcaccggcctctcaactttctagcactgaatgccacactttagaggcgaacagcagaacacacaggggccctcactagattttgggggaatggcctgtttcctgggcccagaattgtatgtgcatgtactaactgggattctccatcatggggacatctgaagccaaaggtaggtgtgtcttccaaaagggaacagagctctctctgggtaaaggagagctgaaaggtcctgagctcttcttgctcctttggtaagtactgaaaatggaacaggactagaaggtatgggattcccatgctggctttaacagaaggttcacagcctgcaggaaggcatggtggctgcagtgcacatgcagtacggtatccttttctcagagccagagtagaactcttgctggggaaggagtcctctgctggagaagggcctggcttagtgacagctctgcagagctcacctggtggcagcaagtgctgcctcttttgccaaagccccattttggaggccaaggaagaaaatgccagacttggagaaagaagagctccccacaccagacaggttacaaagaaaatggtcagtcctggggaatgcctaggtcttagcaagggctgggctaataaatcgctctattttaagcccacaggacataagacagatgcgagaaagagaatgtcctccaaactctgagagcaaagttgagcctggaaataggaaacctaatccccagcctagcattcttcccacttacctcaaggcatccttctgtaatcgtttcatatcttaatttcaacctaataaaacaacaacaagaacaaaaaccctttgatggagccaggtacttctgtgtattattatctcatttaacataagtgacttgtgcttctatcaatggatcagttagtccattagttcactcataattacttatattctacctatttccaaaaaaaaaaggttcaaattggattacaacaaaaggcacatgttatggccaaaagagccaatttttttttttgagcaaagattttgaaatccgtcagctctgggcttgtgacttactatggcggccacagccaagtcctttaagttttctgctccttggttctcctcagttgtaatatggggacactcccaactctatcacaaggtaatttgtaaggattaaatgagatgatgtctgtaaaattcctggcacagagtttggcccatagtatgcaccgcaaccaaaataaaagtaaaagaaaagacttaagtaataaagtctgtggggggcgggagaagaaaggggataatgaatacttacatcaaaatatctaaataagggaagcgctgtactttttggcagttgtggcaaaaggaaagcgggactgctataccattctcattgtttaataaagagaagcatggaaattcatcaggacaaagaaagttcttaattctcaatgcagaagggcacataaatacacgagtgactgtgtatgttacacacatacacatgcttataccatctctctctccaacaggaacagggcaaacggctctccagagtcctgctgccccctgacaccaaactactgcggtgtacagagaagtacttcaagagttaaaacatttttgtgccaatattttaagagtgcagaaggttccaaattacatgtaaaataaacaatgccagactgtgaaaactcttggctgcaacgttctctgatgttaacaagagtttctttattactgtaacctttcagaagtgaataaaaattatttctctgccctagttttgccctccagtaaaagtgaagagagcagtgaccatggaaagagctgtacaatgacctctcctgaaggccgggggctgggaagggggcagtttagaacacaaagccttccatatatgcttctaggttaaaggctagaaatttagtttgtgctgtgctgatcatattgtaaaattttacattcctaatacttttatgtaaccaaaacccttagagcgacaagaaggcattttcaagagcccaacctgagctggtgctatggagaaaacccaaatctggaccatgacccctcaactactcagtgaacccccttactcagaaaccgagtctgaagtgtccttaacaaagaaggaagaagtactgtgtgtgaccagtacttaagacaaaacatgttactactcagatccttaagtgtggatgagtctgtaaatatcagacacacacaaggatctcaaaatggagctagtctggataaagagaatctgcatttaccattgcaggagaagtaagaatgtcaccaaacaaagccaaacattgtttgtcttctcataccaactcggtgcctttatccacactgttcctctgcctggcattctcttcttgtctagcaaacacctacttatctgaaaagatttaactcaaatgtcatctattcccagcctgtctcgagactctgggcattctcagcaatttaaaaacattataatttcttaatattgtaattatctgtttatgtttatcttctcctactagactagggagtcatggaaaatgtcttaatcatccttgtatctccagtgcttttagcacagtacctggaagctaacaggccacaataaaatggatggatagatgggtaaaactttgtttgtgtctgggaacagaaatcagacagagagtgatgaactgctaaaaaaacagaacacaagctctgggacttaacacaaggctagcttttcagacttccacagagttgcagaatgttaagtctggaagagaatgtagaaatcatctaactctcctccccagagaggtgatgtgatttgacttactcaggcttacccgaagagtggccaggccaggcagaactcgttccattatgccacactgtcccttcttactactgtctaaaattgtcggtaaaataagtaatgattaaggtcacatatctaatttcattataaacatatctaatttcattataactaatttcattataactaacacatatctaatttcattataaacaaatgaacaatggaaatcatctaggaattcaaacaacttgataaaagacacaatatctgaattcttcaaaaagtttacatagtgtcaccatatgacccagcagttccactcctaggtatacccctcaagaaagctgaaaacttatgttcagacataaacttatatatgaatgttcacagaagcattattcacaaaagctaaaaagtggaaagtggaaagactaaatgtctattaactgattaatagatttttaaaacatggtatatctacacaacagactatcccaaaaaggaatgatgtcggtcgggggagttgagcaaaaaataaataaataaaaagaagaaaaaagacaaaagaaggaatgaagtactgaaaatatgccacaacatgactgaactttgaaaacattctgctaagtgaaagaagccaaacataaaatactgcatattatatgatcctatttatatgaaatgtcccaaataggtcaatccatagaaacagaatgtagaatagtggtttccaggggctaggggtaaggggaacgggtgtgactgctaatgggcacaggatttctatctgaggtaattaaaatattctggaatagtggtgatgggtacataatgctgcaaatttactaaaaagcaaatttacatgttatgggatataaattatatctctatttttaaaaacagaaaaatggaatatctgccctctagaagctaactaactggagaagctaggaccaacatataagatgcctggctaggcgtggtggcttatgcccagcactttgggatgccaaggtgggaggatcacttgagcacagaagtccaagatcagtgtgggcagcacggagagaacccatctctacaaaaaaacccacaaaaacaaaaacctaagatgcttatggactgaaaggttcaatgctacaatacaagtggatactgtggaagttagaggaagaaagaaacaacacttgggttaaaaatcttaatgccaatgctagagccatagtttttagtttcgtacagagtagtaattaaaagcacaggctctagagtccagaaggtttgggttccaatccaggctcccatatttactgtgtaagtctaattaaattgcctaacagtggtaggtaggctgaatttggtctcctaaaagatatccatgtcccagttcctggaacctgtgcgtgttaccttatatggcaaaaaaggattttgcagctgtgatcaaattaagacacttgagatggggagggaatcctggattacccagttgagccctaaatgccatcacacatatccttccttttaagagagaggcggaaggaacttaggctcagatagaagaaaaggcaacatgactacagaggcagaaattgcagtgatgcagccacaagtcaaggaacatcagcagccaccaagagctggaaggggcaagagtctcccctagaacctccagaagaagcacagccctgccgacaccttaatttcagccccatgaaactgatttctggcctccggtactgtaagagaataaatttttgttgttttaaaccaccaagtttgtggtaatctgctgtaactgctatgggaaactatctctgagccttagtttcctcatctgtaaaatgaggctagaaatgttactaatctcacaggtaagactgttgcaaaatgttataaaattcaaatggtgcttgtaaagtgcatgaaaaaaagaaagtgctcaataaatgttagctattactattggggaactctgcttctgaattatgctgaaatcctcaagtttcacatgtcgttagcccatgcctagaccctgctcctcttagcgaggagaacagtaacagtggcaacaaagacacccgagttctactcttcagtgtttctaatttgtacgcagctcttccagagccaatttcccaatcatctaaatgatataattagtttaggagcagtggttctcaaactagagagctggtgaaaagacagactgttgggtcccaccccagttttcagaagatcaagggtatgccctagagctagcattctttttttttttttttgagacagagtcttgctctgtcgcccaggctagagtgcaaatgcacagtctaggctcactgcaacctccacctcccaggttcaagtgattctcctgcctcagcctcccaagtagctgggactacaggtgcatgccatcacaccaggctaatttttgtatttttagtagagatggggtttcaccatgttggccaggctggtctcaaacccctgacctcatgatccactcgcctcggcctcccaaagtgctaggattacaggcttaagccaccacatctggcctgagctagcatccctaacgagttcccaagcgatgctgaggctgctggtctggggaccacacttttagatctctggatcagattatttcagggttcctttccagtttaaacagtctaagattccccagtaacatccaacagatgcagcactcaagtaataaacactgctgtaccatgctgaaatagccttaaaactaagttctttcctaagtaagagtgggaggccttggaggctgagtatgaagtacatggtaaagactagttttaacttctgaactcagcagattgagaaatctaaagcaatggtggaaacaggaagagactgtccccttatctaacatgttggccccattttaatttatcttaatcccacctttctgccttttcaccagacccctccccgtcacggtctcctctagaaacacatctaggtgtctcctgaattcatttattggctttgccgcacacagtataataccgcctttgttagtctcctggcccggccccttcaagcacggtgttcagtctcggtgttcctctacccttaaaaaaaacacacaaccaaggagtctctgaaaaataattgtaaaatcaactaaggcaaattcagatgatgtagagacactcagactctaaacgatggaaaaagaaacaaattcagaacattgtcagcattctcatgtcttttttttcccccttaatctctattagtcctgttgagtaggaagtctctgccgtattggattagaaattgagtaaaagaggcctcaggcttgggagtgcactgaagaaataaatggaatgcctttagattcaagaaaagctgtcctcttggtctttggcagtccttggtaataagacaggagaaaaggtttctttctttcaattggaaggtaccatggtatagtaaagaggacactggactggaaattggtgtaatctggccttggtcctcattctgctattctctagctgtatgaccttggccaaatcaatgaacttttctgggcatccatttcctcaccacagaaatgagagggtagaaccttaaccagaaatatgtattagaaatcttttggggccgggcacgggggctcatgcctgtaatcccagcactttgggaggccgagcgggtggatcacttaaggtcaggagtttgagacccacctggccaacatgctgaaaccccgtctctactaaatgtaaaaaatcagcctggcatggtggcatgagcctgtagtcccagctacttgggaggctgaagcagaagaatcgcttgaacccgggaggtggaggttgcagtgagctgagaccacaccacacaacactgaactccagaccgggcgagaaagcaagactccgtctcaaaagaaaaaaaaaaaaaaaaaaaaaaaaaaaaaaaaaaaaatatatatatatatatggagagatttttcaaaatgcatatacctgagcctcttcacagactcagaaccgctgaatagagaacctctgaggtacccagtctgacattccaaggttcatccatcctataaagcagattaagtgtataaccaggcttaaatgagagccagggaacccatgaggcagggcagagaaaaaccggacctttttcaaagggggagggtagttagagaaattgaatccaagtgtaatcagagaagatcattcttcagtcagtatttggaatacagggctagccagatgctaacaaaagaagcaagtatttatgttcatccaacacatatttgagtagtgactacggtaggcatgtggtttaagacaccagaaatccaagaatccttatcccatctaacaggagtgacctacataaaccatgagcacaccatggtaagttcagagaagggagtggccagatatatgaacattattggtgaatactggaaaaagcttcttggaggaggtgttatccagcttgtgtcttatagtgccatgagcagacaggggagaagaccagatcagacggaatagcataaacaaaagcctagaggcataaaagaacacagcacacttacggcaccagtgaaagtctggcatgagaagaatatgtatttgtgtgcatgcacttgaacttttttggagggaaggggtatgatttgttgcagattaaactagaagaatgggctggagccagaacatgaatacttcttttctctccaattttttgctttgaagaatttcaaagaatttttaaaggatgtaagagtaatacaacaaaaactcatataagttgttttgagatctgcaacttcaaatggttcagcaaaagaaaagggtgtgtatatgtatgggtagagataaagcaaatgttgcaaaagattcagcattttgcacaatcttagatgcacaatttttttttgcaacatttgtttatctctatccatacatctacacatccttttcttttgctgaaccatttgaagttccagatatcaaaacattttacccctaaatacttcaatatgtatctgctaagaacaagcacgttctcctatgtaactacaagggttctatatgcatccttacccactctaataggagggatctatataaaccaataattacagcacatcatggtaagttctatctctgaagttggtgtagtgctgcagtaacgcagagtccgatgtgccactcaggacaggactggcaccctgactgtatgcacctatgcatctgaccagttgtaaaactgcctgaggcacctactcctcgaactcttgctacctcttaaggcctaggggtaggaaacatgtgtaaagaaaggcatgtatctaccagacgtacatgttcagtaggaccctgcttaaattcgtaagccaatcccaaaatggaattactctgacttcttagaatttagccttctctcccctaataactgactatccactccaacagctcaggccattttagaaactttcaaaagaacaactggtatctgagaacatgtattcttattttcatggcctcaagcccaagggactgtcctttagttacactcacacttttttccccccacccaagctggagtgtaacactgtgatcacagctcactgcaacatcaaactccctggcccaagtgatcctcccacctcagcctcccacagagctgagaccacaggcatgtgccaccataaccggctaattttatttttgtaaagatggggtctccctacattgtccaggctaactataccttttaatgtgctccttgtctttaaaaacaatacctttggcagtgagttttaattctgacctagagatgcaaaacagtaaaatttttatatcgtaaaatagaagaggtctgaaaatttttgtagggaaagagaggcgatttggtgacaggtggtgattacagaggcctgaaaggaaattttcagaaaaactaaagcctcctaaaatgtaatgcctttgttagtttagaaagataaaataccagccgggggtggtggtggctcatgcctgtaatcccagcactttggaaggccgagaagggcggatcacctgaggtcaggagttcgagaccagtcgggctaacatggtgaaaccctgtctaaaattacaaacattagccgggtatggtgcacgcctgtaatcccagctactcaggaggctgaggcagaagaatcgctggaacccaggaggcagaggttgcagtgagccaaggtcgcgccactgtactccagtctgggtgacagagagagactccgtcaaaaaaaaaaaaaaaaaaaagaaagaaagaaagaaagaaaataaacataatataccctatgtataacctggggtttttaaaaaatcaagtaattccattagaagatggaaaagtatgggaaaaaggaactgaacagttgatggtgggggaaacgatttatttccttttcttccaatatttaagactaacacagcaaacaaatatcctcagaataaaaaacggtatctccctgccccactttttccagtactcattctgggcctgcaggactggcttccttcattcttcagatagttactgggcacctattcaggaaaggggcaataacaggcactttggagacagatgtacgtgatcctgcaccacaggaattcacctggaagacagtcaacataagtgaataacagtgatacaaaatagaaagagtaagagctggaagaagggtagatataaatcattaaggtacttccttaggggaaactgggattggcttccagttagctgtggaaggatgtgaaggaattgaggctggggtgttagggcaatctaggtgtatgcatggagtgagcaaagacacaagacagaaatagcaaggaattcagcttggctggagtgaagggtatgtgaagcaaggatggaatgtgatgttcactgagtgcttactaagtgccaggcacatgtgctagtaggtttcacatatttaaggttcaagaagaactagaggaaatgagtttggagaggtggtctggagtgtgatcgtagaggaccttacaaagcaaaatggtggttctgagaagcaaggcagaattacacaagagtcaagttcagcccacagttcctccatttttcctaggccctctgcatcatcccatcaagcagctctgctagagagtgagcaggggaccatgaggtgacagaaggtgcattcttattccagaagtctcactgaggcaacaggcatgccagggaccgctgataagggtaaactgtaatttctcaactacagcccactcccatcccttcccatctctgtcttggaaagcttgagcctgctcattgtgagccacaaggtggagatgtctggcagggcagaactgagaggaagtcgtttagccagcctaaggttaccattaacactttgagccactgccgtgagctaatttttatgtttgttttttaagtttggttgaaatgtcacaaatggaaaaattaagtaaagcgccctggttagccacaagactggacacacctggctgcaaacccagcaaaagaaacttacttcattagtaggagaggcagagagtgaaatttacatctgaaatctgcctgcaccaggagaaagtgctgaggccaaaggcgctgtctgtttttacagctgtgtcaagacttagttctttactcttaccaacactcaggagtgcggcaagggcccaaggaaaaatggtctccaagctcttcagctgcaactcagctcacaaagatttttaagaagcagttaatgaaataaaactagaccagatgaggtgatataatgaactttatttccacagctaatttataagtttaaatcccaaataatgtttttttaagtcagaacactctaaattattgatgtgatttttgtaacctcaaatttaacacctgctttttgtaccagcttcacgatgatatatgagtctgctccatttttcacaatagttgggctccaaaaagttggtgaaaagcaaatttttgtaaaataaaaaatttcccaccaaatcagaatagaattctaatttcaaaggagtttttgatgcaaatttattattcatcactaactcgaaagtggctctcttatttcttgatcttccacacaccaatccactcaaagcaatcacctctaagtttttggcatgagaaaaatcactactacattgattggttttataaattctacattttatatgttttcttacagaggtacacctgggatgccaaataacacagagatagatttgcaaattaccaccttcaaaccatagattttcaagctgaaaaaaagctgaaaacttggggctcatgtagttaggcctcccctgtccccacctttcttttaatacagaaactgaagcacagaagaggaaagatttgccagtcagggtgagaaccaggccagactggctctacactgcctattacttctccctagccacgtgtcccatttataggttgtacacacacggaagactgagatcccctcaaacacacacatgcactcacactcatccatgcatgcactcacaacccagtgattaatatacaattgtcttgcctatataaggcatgtctatttatgccatgaggttagaaagaaggtatcaagtcaactatagcagaaagcagtaatagtaattccccaactcttccaaatctctattattttaaaaccatcatcctttagttatagtctttgtaactaaaccggaatttgggcacttctcttcatgaaggcaatttaagagcctgtattgggggaccacctaaaaccttgctattgtcccctaccccaccctgcgtcactagcaacatccgcatcacctggaagcttttcagaactgtagattttctcacccctgtcctgaaacttactgaatcagaatctgtattttaacaagatcctcaggtgaaccataggcacattaaagtatgagaaacgctgatctaaaacactcccttatggggcagcaccctatctacaacaatccaaatagaaaaaacggctggataaaatgcgataggggaaaaattccccaattcctgcaggactgcactgatatacacttggatcagagactaataaagcaggtatgatttatctaataaatgttagcttaaaaaagaattccaaaggctggtattcaatatattcatttatttgacaattatttattcatttgacaattattcaatgtttactgcataagcaaaaaactgaataagacggttttctgcttttataaaacttacagttaagtagaagggacactgcataagaagtaacatgggagaaggctcaagtgttgacaactgtgatgaagagagatggaggtccagaaggaaattcaactgtggcgagaggcaactaaaaggttcctgcagtccaggagtcagcaacctatggctcattaagctattcaggatagagacagctgtggctcatatggctagtgagacaacttccaacagagtttagtcaacaatgataagaagaacagtttcactacaggaagagctactgcgcaactgcctggcagtcagccagggctttggctgaccaggaggtatctctggccatcattaaataggactgagactgccaacaccaccttatgtccactgtgcactgctacagagttgggtggtaagtacttgagggcatgtgggaacattcagctggatgaataccttaaaggctgccgatctcactctgggcagctgtgatattgtgaaatatatagttggtcttcaactcccttcctggcatacaactcctaaaatctttggcctttccaaagtggtgtcattttgtatgctaatgattggtggctggcgcacttaggtagcttcagggtaggggctggtcactgaaaaaccaagggaggattagaaggttaggactttctgtcccatctcccaacctccaaggagggcagagaggctgactgatttccaatggccagtggtttaatcagttgtgcctacataatgcagcttccataaaacccttaaaaggactgggtttggggcacttccagatagctgaacaggtggaggtttctggacagctgcacaccaggaaaggtatggaatctcctcaccccttcccccatcttgtcctatgcatctcttcatctgtatcccttgcaatatcctttataataaaccggtaatgtaataagtgtttccctgagttctgtgagccgctccagcaaattaattgaaccaaagaaaggggtggggaaccccaatttataatcggttggccagaagcacaggtaaaacagcctggagcttgcaattggtgtggcaagttgggggcagtcttgtgggcagagccctcaacctgtgggatctgacactatctccgagtacacaatgttggaattgaattgggttagaggacacccacctggtgacctctctccagaattgactgcctgtttgctgtgtggggagaaactcccacaaatgtgtcacagaaaccttctgtgtaattgtaattgagtgagagagctgaaaaaatactttttttctctatattacacagcagctacgacagaaagaaagcaaaaaatgaaaaaggaaccaaaaaggatgattacaaagatagctctcaggcgaaggatacgcatcaactcaaaaatggttacttttctccttccttgaaggtaagaaaaaataacataaaaaataaaaaaggttacttctggggagttagactggggggaaaaaagacacttgttttttacactcaatactttttactctttgatttctattctatgagcatatgtaacttttataatatgtttatttctcagtccacagggagaactttgccctgtaatgaaagaaaccaaattaacccatttcatgacccagtcatggttctactttggatgctcccaagctgggaggcaatgaaatgcttcccagtaacagggaactacaagctactaaaacgtgatctagatacacaaaatacacaacataaacaaaagaagatactagtgggaggtgaagccagctgggcttctgggtcgggtggatacttgcaccaatcagtgctctgtgtctagctagaggattgtaaatgcaccaatcagcattctgtaaaaacgcaccaatcagcgctctgtgtctagctacaggattgtaaatgcaccaatcagcactctgtaaaaacgcaccaatcagcactctgtaaaatggaccaatcagcagacatgggcagggacaaataagggaataaaagctggccaccctagccagcagtggcaacccgctcaggtcccccttccacactgtggaagctttgttctttcggtcttcaccataaatcttgctgctgctcactctttgggtccgcaccacctttaagagctggtaacacttgctgtgaaggtctgcggcttcattcttgaagtcagcgagaccacgaacccactggaaggaagaaactccggacacaccatctttaagagctgtaacactcacagcgaaggtctgcggcttcattcttgaagtcgcgagaccaagaacccaccacaaggaaccaactccggacacactatgatctgtataaccagctatattctagtgttttggtttcatttttctattgtcattacatcccatgtgacatatatatatatataatatattcccctttctcaggttaattattaaatgtactaatgtacattttcaggaggtatcttaccagactcttctaggttgccagtgatcaaggagcttgagtttcagttcctgaagacagtgcaggccccataccagggcctcccatcagaactaatttatagaaggactggttcaaatattgaactggtgtcaaaggtatagtatccttaactggattatcatttgattccctccattcaccaaatccatccctcctatcaccacgatttgggctttacaatcccatctccatacaggatgacttcacactgacaaatcactataatgtgtacaaacacataaagtatctgtggagtattagtttccacagaggcagaaaaagtgactttagcggaactgccacttgatattaggcagcatttcacagaaatctaaaagcagggccattttacaacagataaaactccaaactcaaacccttctctggaattgtccaggacaagcatctgacagcactcacttacccccatgactctgccgcgctgctgaacatcctcccacataaaatgaactatgatacgacacatgtacttcccactccggccttcctgcttcattcggactagacacatcctgggtgggaagaagacaaaaaaagtcttggctgtttgcatttttcacatcacacatttccactgaaggtctcctcatctaagagtgagtttagcaaagggcaccaaatcaaactggaagtgaactttttttttttaaacttttactgagatataacaaagatactattaagtgtataaatcttaagtgtactgcctgataaatttttatgtattatacatacacccacacaagcaccacccagatcgagatacagattatttagggcacctctgaaggctccctcatacctggagggaaccacatttttttgttagaagacaaacaagtctgaatccttcattttactgatgaaagcaggagtcctaaagacggaaagtaatttgcccaacaccagttttatatccgtaaaactgggtatagaactgtgctgtccaatacagtggctcccctgtggctattgagcattttaaatacagctagtcaaagctgagatgtggcacaagtttaagatttcaaagatttagttgaagaaaaagaatataaaatatctcaatttttaatactgctttcatgttgaaataatatttcagatatactgggttacatacaatctattaaaatttgtttctttttactttttcaaatgtagatactagaaaattttaaattacatacatggcttgcgttatatttctgttggacaacacctgtccagaacacagatcacagaaagtattatgattacatttgtgtaattatccaattgtttcccccactagaaggtaagctctactgaagataaagatcaaatctggtttttgtcaacattttatttccagggcttaagtacagtaggcactcaatatacacttgctgaataaataaatgaacaaacacctatggttagggccaagtttaggaccttttcccctataccacatttgcctctagtcagtccagagggctttctgaataatcaagacctcacataatctaaacatacaagaattatattttattatatataggaatataagcagggtccccaacttttcaaactagttcctcatttcatgcatgaccatagttcattcttttttgttttgttttgttttgttttgttttgttttttgagacggagtctcgctctgtcacccaggctggagtgcagtggcgccatctcggctcactacaagctctgcctcccgggttcttgccattctcctgcttcagcctcccaagcagctgggactacaggcgcctgccaccacacccagctaatgtttttgtatttttaatagatatggggtttcactgtgttagccaggatggtctcaatctcctgacctgtgatccacccgcctcagcctcccaaagtgcttgttttctcctttttgagacagggtctcattctgtcacccaggccggaatgcagtggcacaaacacagctcactgtagcctcaacctcccgggcttaagggagcctcctgcctcagcctcctgtgtagctgagattacaggtgtgcaccaccacgcccagctaattttttatttttttgtagagacgggggtctcaatttgctgtgcaagcagatctcaaactcctgggctcaagacttcctcccactttagcctcccgaagtgtggggattacaggtgtgaggcaccatgcctggcagactataatttttattgtttctcattaaatagcttattaagcagctacaataggattactcacctaaaagacaattcctgttataattatggaatagttaatccaacctgacaattctatatccatacacaattgatcttgccaattaaaatctaccagcaatagtaatggtacaatgaaatgattacagcttggcctgtctcaacatctttgttaataactaagatggagaaaagaaaacatatttaccaaatttgcaggtgacaagaagctgggcaggagaacaaatgtgccagatgatccaaccatgaaccaaaaatacttcaacaggttgaatctaacaagatcaacctaatggggataaattcaggatcctgcatttgagtctaaaagaacaactgtaaaagtacagcacagataagtcatgcctacctatgtgtgaaaagacttataggcttaagttgatattatgtgctcagtaggaatcaagaggataacaatgctgccctccaaattaatgtgattttagatacagtaatgcaaatataataccatcaatgtgtaaagtgagacttttgttatactcaacacaaaccagaacgtatttggaatactatccacagttttgaacattacattttaagaaataggaggactagaagtatcttaagaagaccagaagatatttaacctggagaaaaacaggaaagttgacttaaacattgtagaaaagcaattaaactgtttaccaaagagaatcaggtcaggcctggtggttcacacctataatcccagcatttgggaggccaaggcaggaaaatcacttgagcccagatgtttgagaccaacctgggcaacacagttggaccccgattctacaaaaaatatgaaaattagtcaggtgccgtggtgcatgcctgtagtcccagctactcaggaggctgaggcaggaggatccctcccaaaaggtcaaggctgcagtgagccacgatggtgccactgaactccagtctgggtaatggagtgagaccctgtctcaacaaacaaacaaacaaacaaacaaacaaaaccaaagagttagaatcagaaccaatgggcaggccatagagggagaaagatataatcaacattgaacagcaaaattaaaagcttactaacaggaatgtctaaagttttgtttttttaattttagagacagggtcttgctctgtcacccaggctggagtgcagtgacacaatcatagcccactgtaacttcaaattcttggactcaagccatccttccacctcggcctcccaaagccctgggattataggcatgagccactgtgcctggcctgagtgtctgaagatttgaataatcaaactgacaacctcaaaaagtagagaatttgtctgtcacggagaagtgaatcaacgcttggtgggaactcgggtatctgacagaaggttgacaacatgaccaggtgcagtggctcacacctgtaatcctagcactttgggaggccaaggccagtggatcacctgaggtcaggagttcgagaccaacctgtccaacatggtgaaaccccatctctaccaaaaacacaaaaattagccaggtgtggtggtgtgcgcttgtaatccagctactccagaggctgaggcaggagaaatgcttgaacccaggaggcagaggttgcagtgccaagatcgcaccactgcactccagcctgggcgacagagtgagattccatctgaaaataaaaagaaggctgactacatgatcccaaatgagatttactgatgtgattcgaaacttgtaggccaggcgcagtggctcacacctgtaattccaacactttgggaggccgaggtgggtggatcacctgaggtcaggagttcaagaccagcctgaccaacatggtgaaaccccgtctctcccaaaaatacaaaaaattaaccgggcgtggtggtacaaacctgtagtcccagctacttgggaagctgagacaggacaattgcttgaacccgaggggtggaggttgcagtgggccaagatcgcgccactgcactccagcctggtcaaaagagcaagactcttgtctcaaaacaaaaaaacaaaaaacctgtaacctctgaccccaggtagtgcttaagaaatagcactttgtaggctgggtgtggtggcttacacctgtaatcccagcactttgggaggctgaggtgagcggattacttgaggtcaagagttcaagaccagcctggccaatgtggtgaaaccctgtttctactaaaaatacaaaaattagccaggtatggtggcgcgtgcctgtaatcccagctactcgagacactgcggcaggagaatctcttgaacccgggaggcagagattgcagtaagtcaaagatcacgccactgcactccagcctgggcaacagggcaagactccatctcaaaaaaaaaaaaaaaaagcactttgtgacaataatgaaacaggtcacagaaaaaagatttggctactttataggacacagagcctattccacagcagaaacaaactggggaaaagttcaacagtcctttttcataagacttttctaaagttaatcaaatccctcatgtcagcctctcacctgaaaagacgctgtgtgttttgatgcttaagtgttgtcagaggccaattcatcaacagcaatagtgaggtaatggaattcttcatttatttgaaaattctgtagtttgttaatacacctgccctctgaggtttaaaaggcacagattttctcagaccataaactttctaactgtatcaacatgggatgaagtgttttttgtttcacaacacagtttgttctatagcccttacagataacagtgggctcaaatggttatccagttgaaaagataaggcaaaatgaagacactttcaaaatggtgactgacaattcactcaatgaacacaggagttcctattgtgtgaaggtgtatggttggatgctgtggggattatagtgatggctaaaactagaacccagcttttatggagcagtttcctctaggggagataaggtacaccacacatcaacagccctaaaagggaatgccatagatctcccaagagaagagtgcaatgaagtttaaaaggatgacttttggctgagtagaatcagagaaagcttcatggaaaatgaaacactgtacctggatcttagaaggataagctgaagttgaagaggttgagacaaaagacaaagggaatgtccagctgatggaatgttctaagcaaaggcagggccatggaagagttcaggatgttaaggtaacaatgaatacctagattgtggggaggacagggtataggatgcagaaaactgaagccagaaaggtcatgaagagctttgaaatgacttgctaagaaaaagtatggactttgctcagcagagagtggccagctactggaagaagattcgctccttagcactgaccggagatgagtctctgagaagttaaccttttcttcccagcctcaatcctataattaaatatacaaatatcaccagggctggaaaaggacaaatttggtgaatatagtcatgtaccacataacaattttggtcagcaagagaccacacatatgagagtggtcccataagattataatggagcagaaaaattcctatcacctggtctagatgatcctgacctggtagaggcctaggctaatgtgagtgtttgagtcacagtttggtttttgtttttttcagagacaggttctcactttgtcacccagactgcagtgctgtgatacaatcacatctcactgtaacctcaaactcttggactcaagctatcctcctgcctcggcatcctaagtagctaggactacgggtgcacgccactgagcccggctaattttttaaatttttttgtagaggcagggtctcaccatcttgcccaggctggtctcgaattcctgggctcaagtgatctaccttggcctcccaaagtgctaagatacaggcacgagccactgcgcccagctctatgtcttaatttttaacaaaatttttaaaagtagaataaaatttaaaaaaacagaaaaaaggttacagaataacaatataaagaaagctatataatgtgtgctttaagcttaaaatgtcagagtcaaaaagtttttttaggttgggaacagtggctcacacctgtaattccagcactttgggaggccgaggcaggtggattacttgaggttaggagaccagcctggccaacatggtgaaaccctatctctactaaaaatacaaaaattaaccaggcatggtggcgcgtgcctgtagtcccagctactcaggaggctgaggcaggagaatcacttgaacccggaggtggaggtttcagtgagctgagatcatgccactgtactccagcctgggcaacagagcaagactctacctaaaaaaaaaaaaaaaaatttaaattaaaaagtttataaagtataaatgttacagtaagttaagtttaatttattattgaagaaaaaatttcaaaataaatttaatgtagcctatggccaggtgtggtggctcacacctgtaatcccagcactttgggaggccaaggtgggaggattgcttgaggccaagagttcaagaccaaccaaggtaacaaagtaagaccccacctctacaaaaaaacgtaaaaattagccaaatgtggtggtaagcgtctgtagtcccagctactaaggaggctgatatgggaggattgcttcagcctgggaggtcaaggctgcattgagttgtgattgtaccactaaattctggcctggatgacagagtgagaccctgtctaaaaaaaaaaaaattagcttagcttaagtgtacagtgtttataaagtctacagtagtatacagtaatatctgactcatccagagcaacttctagttctgcaagctgtatttatggtaaatatcttatacaagaataccattttttatttcttatattgcatttttactgtactttttgtatgtttagatacatttagatacacaaatacttaccattataactgcttacagtattcagaacagtaataagttgtataggtctatagcctaggagccataggtcataccatacatcctaggtatataacaggctataccaccgaggtttgtgtaagtatactctatgatgcccacacaataatgaaatacctaatgatgcatttctcaggacagatccccatcattaagcaacacatgactgaatttactttaatagaacatcattttcagaatattctgatccagaaatataaactaaagattatacctgccttttgagaaatatacaaccagcaaagattgttataacctgtacctaattttgctgatactaacagtttagaagacatggattgacacctgaaaataaaaggagggcaaattctctttttttttttttgttttgagacagagtcttgctctgtcgcccaggctggagtgcactgacgcaatcttggctcactgcaagctccgcctcctgggttcacgccattcttctgcctcagcctcccgagtagctgggactacaggtgcccgccaccacaccgggctaattttttgtatttttagtggagacggggtttcacagtgttagccaggatggtctcatctcctgacctcttgatccgcccaccttggcctcccaaagtgctgggattacaggcgtgagccaccatgcccagccaaaggagggcaaattctcattactcctaaaacattggacccaataagttcaacagaccttttattgatgcagaacactaaatattgtaactcttcatttaacatcacagatagattcttggaaactgtaactgtaagcttaacaacttacgaaacctattttaccataggctaagtgacataaacaagagttatattcctacagtatatttctggtcacaaaaacatcactaaacttctaaataaagacccaaaagacttccaatattaaacactgaaataatgtgagctatgcatacattatggcacggcacactcacacccacacccactccaataaggacaatttagacatgctaattcaccttctgtgcacatctttgggatgtggaaggaaacaggaggacccagagaaaacccacctagacagggacagaacatgcaaactccacacaggcagtggccccagatgggaattgttatttttctcctcatcactgttataacaaagtgacattgaacagaacaatgtaatttgaagaaatgctatataaaactctaccgcaaatctcattacacataaagttgtaagaccaaaggcaaagaatcagtcttcctatcaaccggaagttactgaagattcccatgagttctactgggaaaataaggttctgatccacagggctgtccaatcaccagtacaacattcagctaattaaatgctcacctaattctttccctgagtttgtgaatcgaatttactaggtagttaaggacagaaaagcagtcctgttgtgaaggacttttttgtttatcctcttcaagggaaaagcagagctgaaggctgggccaaaatcttaagaagtcagctgcctggaatgtccagacaagcagctgaataccaattcttaggccacctgaccttgaagcctatcacattcaatttacgcttgtttgataactgtttttaaaaggtaatacatgtacatagtaataaaaaccaagtctccttcctaccttcatcccctgccaacccgttcctctcccaaagacaacctcagctactagtttcttaggaatccttccacatataacctatacacacacaagtttatgtatgtgtgtattctttttacataaatggtaccttctttatcttcccttttgtgctagcattctacacatactatctttttttttttttttttgaaacaaggtctggctctatcacccaggctggaaagcagtggtataatctcagctcactgcaacctctgcctcctgggctcaagccatccttctacctcagcctcccaagtagctgggacttcaagcatgcaccaccatgcccagctaacttttgtattttctgtagagatgagatggggtttcgccacgttgccgaggctggtctcaaactcataagctcaagtgatcctcctgccttggcctcccaaagtgctgggattataggcgtgagccaccacaccaggccaacatactattattctcagacattaagaaaaaattacatctgatattggaatggaaggatggaagtgaagaaatctcaactccaactctgtgtttcatccacagacaccccagtgaaaacttttggacaccagagataatagattactactaacttatttgaccattattagggtgacatctgattgacgctgaattcaaccagttagtttatctggcaatttttcctattctaaaaatgactaacaggaagaaagaaagaaaaaaaaaacttaaatagcaaaaacggacaagtgctataattaacagttaacacaactacgtgccaggcactatgccaagtgatttggatgcattatttttcctaatttttacaacaactccatgaagctgatacttgtgtccttactgtcctcatttcacaggtgagaaaattgagtcctagagaagtaacttgcccaatgatacaaacctagtaagtgctaaaactgagatctgaacctagacaatctgatcccagagtcctacgaaggtttttgttgtttttgcctcctttaatgattagaacaaaccctccaggatctattgaccctatttttcattcagtcctcacaagtacagtaatttaagcttcaaaactagcatcatattagaaatagcacatcaggaaaaaaaaagactggctaactggaggcaagcatacctataacaagagtaactgctagcagcctagtaggaaaagaggaaatgaaaaatttatttaatagagacacgaaaaaaataacagagcaattgaggttcaacaggtacaactcagagacaatagtctggcaaaatacagttaagagttatcaggacatcctgaatcattcagaaaagactgaagtatgttgaatggtaaaagaaaactaaataggccaggtgcagtggctcatgcctgtaatcccagcactttgagaggtcgaggcaggcagatcacctgagctccggagttcgagaccagcctggacaacatgacgaaacctcatctctataaaaaatacaaaaattaggccgggcgcagtggctcacgcctgtaatcccagcactttgggaggctgaggcaggcagatcacctgaggtcaggagttcaagaccagcttgaccaacatggtgaaaccacatctctactaaaaatgcaaaattagctgggcgtggtggcacatgcctgtaatcccagctgcttgggaggccgaggcaggagaatggcttgaaccagggaggcggaggttgcagtgagccgagttcacaccattgcactccagcctggcaacagagcaagactccgtctcaaaaaaaaattagtggggcacggtggtgcatgactgtagtctcagctacagtctgaggcaggagaatcgcttgagccccagaggtggaggttgcagtgagctatggtagtgccattgtactccagcctgggagacacagtgagaccttgtctcaaaaaaaaaaaaaaaaagaaagaaaaagaaacaaagaaaaataaataaaacaaagtcaaaatggttaataaaaataaaagacttgaagatcctgctacccactgcaaaacaaagccaacacctgtcacagactctgaccatataacaataacgttgagtcattaagtaagctatttcacaatacagctcactttaactcacatcatgggtgtataccctcataataaatgcctaaatttaacattgagaggtcaaattacattttgccactgatttaaagtcataatgtcagacctctgttggaaacgagggggaattgagaagggcagggggcattatggaggggataacacacttccatgctaaaacataataaataaaaactgcccttaagaatgcaggctgggcgcgctggctcatgcctgtaatcccagcactttgggaggccgaggagggtggatcacctgaggtcaggagtttgagaccagcctggccaacctggtgaaacctcatctctactaaaaatacaaaaattagctgggcatggtggcaggtgcctgtggtcccagctactccggaggctgaggcaggagaatcgcttgaacttgggaggcagaggtagcagtgagccgagactgtgccattgcactccagccttggcatcaacagtgagagactctgtctcaaaaaaaaaaaaaaaaaaaaaaaagcaaagtatcagtgtgccaatctgtatccaggaaacaaaaaaaatgcaaaataaacttaaaaaaatcttgtaatgaaaaagattcctatattaattaactaatcatttattgaacaagtattactaagcacctactctgaatatagactgaatctgtgcagaagctactactctgtttaggatcaaactcaagttgctcctcccaagtttgatgtgtcacccaggctggagtgcagtggcatgatattggctcactgcaatctctgcctcccgggttcaagagattctcctgcctcagcttcctgagtagctgggattacaggcacccaccaccacacccagccaatttttgtatttttagtacagacacggtttcaccatgttggtcaggctggtctcaaactcccgacctcaagtgatccacctgcctcagcctcccaaagtgctgggattacaggcgtgagccaccgcgcctggcctgatgatgttcttaaacccacaatttattatttaggttttaagcttcacagtactatccttgtctctcagtgattccagtggctcatacataatactgatctcttttacatataagaaaggcaaataacgcagctagcaaagtaaagaaaaaaaggagtgttcaaacctggcgtgcaaatatctctaaaaggcaagcatggagacgggacaaaggaagaaaatgtcactcactaggaatatcaaataataaagggctgaagctatcaatcctgccttatagaaaataataataatgattactaccatttactatgttctgtaatgtgagacttgtcactgtaagatgcatttacattcattctgtctctcaggacattataactgtccccgtttcacagaaaagaaaacacactctgaagaggttaagtaacttaaggttgcacggtagagaagaaagaagctggaatgaagcctgagctcccccctttttctcccattctgtgatagcaccaagaacctcttcctgctaaataagacaaatcggaaggcaacaacactgtctgtagagttcaaaggaataggagagtttcctagctatgatttcctcctgtcagcctaaatctgggagggaagattcttgttattcctgatgctgacctcctgccaggtactggcagctctgagcatcctgtctcgctcactctgcttgggccctctgacaatgccagttgtgttttggccttgtttctcccacatgatagtttataagctgcttagagtagatctgattttgaattaataaagactagcaggcacttgggcaggttcgtcactctggctgctatgaaggaatcccaaaggggactttcacacagcatgtttcccttactctgtcaccagctgaggccaagaaagcagagcctagatggctacactcaagccccagcagtgtgctaatgaatgagtttattgatctgtaagctggcacactgacccttttccagggctgtgtacatggctatctccacctggtttcccaaactccctcactatgaagcctaacccttctggggggagcatgagggccacaggacagcctgtgggcaaacagacaagttgggtgaggcacttcctgaagccatctcacctgacaacgagcctcctccaagagctacacctggcctgcagcttgcctgtcagatccactataaagaataagcccctgggtaccaggtatcagcgcacttagggtatgcaatgctggtaaaatgctgctgcataggcctttggtttgggcaagaaagctacaagcgtgggtgtttgaacactgcaactctggctgggggagggcaaaagaggatgtgcacatggccagggctcaccatgtatagcaggcctggggttgctggaatccagcagaagcctgaatgccctacagctacatcaaaagtgctgtggtggttttaaagagcctctgcagaggctgccagtgtctgccggtgcagttctctggctgcgctgagactggcaccagtctgctttctaaccctttcccatccccacactttaattccttcttttctttcccaaaggcttcttcccttcagcttatgaaatcattccagtgtttccccattttaaaataaaaaacaattaatgcttcccttctgaactgtttttccctcaagcgatcatcccctcatttgaaacttcttgaaaagtagtttacaataacttctttgcctcttaattactcctcaatcccatatagtctgttctggcccccagaaggccaaggcaactgctttccttgaccatccccaggcaaccccccttcccccgtgatcccatataatctgtacatcaccctgtgctagtttcaggtttacctgtggcctctcccaggacacagatagtgagcgccaagaaacacggggcccatcatacagctggtgatccgtaaatgtttgctgtgctcatatgacatgttcatactcaggggaagagacccctatcccctgaccaccaaataggacaatcagaaaggaagcaaagtgtttagaaggggcaggtaaccatagttaacttcagagttgtctcgggtcagccactactgagtaagtggcctgagacaattccttaaaattgccaaaactgtctccccatttgcaaaatgagagaattggactagatctgtagtttttaaactacattctgagtttccatggaactacttaacagtcttttttcagtggacatgttgtgaagatgtgaagcaagcaggtcattcccacctcctttcatcatatttatcatatatggtggctgagcataagatttcatttttaaaaaggactctgctgataaaaagtttgaaaaccactagatccctctacctggaaggctttttcatccactctttcacttgctaacttctactcaccctttaggtgtcaatgtaaatgtcctcttcagtgaagccttccctgactgacccacccctaaactaaatgaggttcccagcttctcccacatagccttgtcacatcctctcattgcacctatcacagttgtattttattagtgatttgtttaatgtctctcttctcacctaagccttaagagggcacgaaataaatttgtctgctgtacacagtaccttcaatcaagagaataaatgccataattttatgaatctatgtttaagtaggtactttagtattaattaacattaatttaagtatttaattagttactttagtagttataattactaaagaggaaagcaacttaatgctttcagttagccagaccagcacctgaatttcctctccaccacattctaactacttctttgggaaagttctctgacttctctaagcccctgatccctcatatgtaaaatgagaataaagtagttgtgagcatgtgtgaaataatgtatgtaaataaataaatgataatatacataaaacacctagtagtaattgtatttatgaaatacctgactttaaaataatctttaaaaacagactacattttactccctctccatcgtacctccatcataggtatgttccaattttatttgttccattccattttgtaaaattaatttctgcactgagaaggtactagtgctccatgacaatttgaaaaggggagtctctacaaatctgttaacacttacaatgccaacacaaattccaactacataaatctccctgcccagaagggaaggtttcaaagcagagataatacctgaattggatactgaaggaaaaacaggaatttgtcaagtggagaggcgggggaagggccttctaggcagaagaaactttgtgcagaagacttgatatttctactacatagttttgctttttcttgcagagaagggagtagtgatggtaatagtgcctaaaatagcaacaaatgagactagtaaaggcaccataggtcacatttgatcagatgtgaatgccatgatatgaaacttttattttattttattttccgagatgaagtctcgctctgtcgtctaggccggagtgcgtggcgccatctcggctcacagcaacctcagcttcccaggttcaagcgattctcatgctttagcctcctgagtagctgggactacaggtgcccgccaccatgcctggataatttttttgtatttttattagagacagggtttcaccatgttggccaagctggtcttgaactcctaacctcaggtgatctgcccacctcagcctcccaaagtgctgggattacaaccgtgagccactgggcccggccaaaacttgtattttattctgagaacaatggagaacattaaggagtgagtgcatgtgtgtgcgtgtgtgtgtgtctgtttgtgtactgaccccatttgtactgagaaggccaatggaatggggatagggaagctagaggccaaagaccacttttcaagtactgttggttgcaactcagtgaaatcaatttagtgggtgacattatcaatgtctgtttaaaatgaattcaaatggaatagaaaatatcaggggttccctctctcagccttggagcctcctccctctgtctctgtacaggggagctgcttctttcttccttcccccttctttcttttctttcttgcctattaaactccttgctccttaaaactaaaaaaaaaaaaaaaaaaaagaaagaaagaaacaaaagaaaatatcagagattacctgacattataaggataaattttacagaacttctgtatcagattcatgtgtccattctggtcacaaagtaacatgcatttgttacgatgggtcagagtcaaaaaaattttgagttaggtgactgagcaggtgaaggggtgagagaagagacaaatgagggctcccaggtttctggtgtgggcatgatgccagtggccaagacaggatataggggaggaggcctgcttttatcaagtccacgtggggatgctagacagcgcagacagtggcctctctcagcattttttcagcagccacagtcaatactaatcttgttcagcaaagacaatgaacacatagtcattgcagctgcaagctcaagtgagtatacaactgataagggtcctctaggagctggagggtgtcccagtcctaaatcctaaaccacagaaaaactgtgaaactaaaaaaatcagacaggataagtgaaacaccatttcctccagggaactaacagggtgtgagaaatcttgtccttattctaagagtcaacagggaacccttacccttgggaacctaagcaaaccttctgaaatgtcagcgaccagggtatttttgtttattagtagtttgtttggttttggttttgtttggcggaggaggcattatttctacttttctgttttctaagcctcctcccccaccccacactaccacctccaagaggtacttcaacccctatgcctccagcaagtccactgagtcctgtaatcttgatgtggctatccttcggttaccctcctggagcttcaggctaagagagcagggccaatagaacatggcttctccacagacttggggtggatccatcattcctcctaacagcctgcccaccccgcccctgcacgattccattagaagaaagacttctccgattcttggaggatcacagcacaactgagccccaaactaactactttcctggtgacccttccactacattcctcaataaacctgccccagacacatcaggcaactggctgccctcaaatactccatgttcttgtacacattctatcttttgctcctattattccctcaatctaaaatgcccaccctttctctgacagaaattctagtcactcttcgtggtgcatctcaaatgtcacctctaccacaaagccactctttatccaacactccaccccatcaccaaatctggatttagttacaccactttgtgcttccactgcatctgcctgtgtcttgggcacagcatttctttcactggcatgcattataggcaatcgtgctttatgtctgttttccattagacttacatttcttgaagatacagacacagagtctgtatctgatttgcccaaaagaaattaccagaaaagaatgcatgtcatacccttctctccaacatcccatggtcctgcacacataggaggtcctcaagaagagtgctgattcaaactgaaaagctacagattctttccaccaaaacctgcatatcatcagaactaggcgagagaaagagtggaaggggaatcaagtatagatttgaagcagacagcttccctctctcaattgaactgggggtggtacaccctactcctcagaaattaaaccaacctcagcaaggaagattaagcaggcacagtttggaaactttaaagaactataagtagtttcaaggttctcccatctgctgttagtcaggtattgaccttgggatgtggtcacagggattatatattttattttattttgccatccactccctctaacactgatacctctagctatatgggcaataaagagtctttcatacaggttctgaatattatctttgagttcccctagccttcttgcaaccctcccacctttccagtgagtaattttacagtgccacctctacagtcctcctctcctaaaaaagcactttttcccttcaatatatgcagcttccttccctgaacgctatgccttacccttcaccattcagacaacaagatggcaggcagtgtgccttttaagctacctgatgcgtggcacatttcaaagaactaacaggtagaagtataagggttttgatagttgcagcttcctttgtgatcctataagtacttcttactcatatttattatataacttaggcattctgatttataattgaccattttacacatcttatctccctcactagactgtgagcttcttgagaactattccctagttcccacaaagtgcccaggatatggtgtgcacttactaaactactgcttagaaaaagatagcataggctgggcacggtggctcacgcctgtaatctcagcactttgggaagccgaggtaggtggatcacttgaggtcaggagattgagaccagcctggccaagatggtgaaaccctgtctctactaaaaatacaaaaaaatcatatgggcgtggtggtgggctcctgtaatcccagctactcggagggctgaggcacaagaatcacttgaacctgggagacggaggttgtagtgagccacaactgcaccactgcacttcagcctaggcagcacagtgagactatgtctaaaaaaaaaaaaaaaaaagcataaaataaactgccaccttaggcccctaagccaaactcagtgtaactgtgtgagtacagaggaagaaacatttcagaggtgatcaaaaccaaaaagtatatagtagtcagttgtatgatgcaaaggttcagctgaaggcagtctcaaacaagggtccttttgacagggcagccattcccatgttcctcagatactcactatggtcaaagtagtaaacttagttctccagaatttactttcccaagatctggcagttcaataaatacattccccagcccctgacttcaacgactctcctatatccttctgacctttaatactgtgtaacattagatgaaaaattgattttttttggctacttatttcacagctgaagaaaaaatatactgtttaaggtgttaaatatttttacatgcaacaaacctggcatgaagctaacttgtatgcacattttagaggtacaggcgtaaatgtcagtgctataatttgttataggtttctgatgaccagcaatgaaaatgaccacggattctcacaattcaaaccacttttacgtaaatgtgaactttcctaaaacagccaagggagagaaaactttccatccaagctcatagagtgtgttaagagatactgatagcattgttcactgggttaggtgttctctgaaaaaatcctacaaatattagtttccttctgggcttatgctttgacctttaataaaaatgtgcttcaagacaccagttattaaaatgaaaggaacagtttttaacacctgaacaactgccatttcatataatcagccctcctgaaggctataccttacaagtcagcagtgtttaaaaaaatacatttggtgacttcatttaaattgctcacttaccagacgtggagtagggttataagaaaccatgaattgaatgtatcaggcatctgacaccctagaaaataacaataaggtataagtatgtgagggtttaaaggaagcatattgaccatatattaaatattggcaggcacggcacttatggtgctctctgattatgctattgcagaaaagtccagtagaacaatagggcgagaccacaggataaaagaactttgaatcatagcacgccaggagtaaaagaaaaaaaaaggatggatgcggtggctcatgcctgtaattccagcactttgggaggccgaggtgggcagatcacctcaggtcaggagatcaagaccagcctggccaacatggcgaaaccccatctctactaaaaatacaaaaattaaccaggcgtggtggtgggcgcctgtaatcccagctactgaagaggctgtggcaggagaattacttgaacctgggaggcggaggttgcagtgagccaagatcacgtcactgcactccagcctgggcaatagagtgagactctgtctaaaaaaaaaaaaaaaaacaaacaaaaaaacaacccattgaatttagtcagaccaccagccttctagttccagccctgttaccagcttgttatgtggccttggacaaatcacttctcccctttgagtcttggttttctcactttgcagaatgtggcctagatgatttctatggttccttccagcttccgtgtgcttctacagtattttccctccatgggcttgaattctgaaaagctaggcaaacactcccttacttttttcagttgggctccactgagaagcttaagtctttctagtatccttttcctgtcttctttctctaaggtacccaatgtgctatggatatgggtgtgctaaatgatttgcccaaaagaaatgaccaggagctgggtgcagtggctcacacttgtaatcccagcacttagggaggctgaggtgggtggattgcttgagcccaggagtttgagaccagcctgggaaacatagtgagaccccatctctacaaaaaactacaaacattagctaggcatggtggcatgcacctatagtcccagttacttgggaggctgaggtggaatgatcacttgagccagggaggtagaggttacagtgagccaagatcatttaactgtactcacgcctgagtgacacagcaagaccctgtctcaaaaataagaaaaaagaaaaagaaaagatcaggcgaaaaaaatcagggctctagggagctgcagctgaataagaaagcatattgtacttactgaaaggctgttcatcacccccccagaaatgacaaaactgggaagggcttctccttggtttcagatcccacaaattagttctgtgctcagacatcaaagcctctcaattctcactcagctaagaaaagcctcctgctggatgaggggtctcccactgaatgtgcccgccttattacataacagggagaaaagccagagcaagaggaagatgcaaaaagagaataagtggggaatttgggcccttatggtagaatctgtcctttggggcaatgactcaagaaagaagcgctatcctctgcttttcagcaaccatcaaggtacatgatgtactaaatgataacaaagaggggacactaggagataacacataggcccggacccccatgaggtacattaacagcaccaataataaagagctgtaattcactgcgggcttactatgtgccagatgttctactgggttctttacatccatgagctcaatgaatcctcccaataaccctgaggtaggcattgatattatcccaaattgacaggtaagaaaactgactcagagagaccaagacaattgctgttcaaggtcatacagctatgaaaagagacacctgagatcaaattcagatctacttgattccaaacactgtgttcttaatcctgctctaacagcctctctaataccactatcagaaactaactcactaagggcccatctgcataccagatctactgcaagccatgtcaatacattatctcactcaatcctcactttaaccctggagggaagcattataatcctcattttagagatgaggaaacagactcaaactaagtaacgtgtgggcagccacaatattaacaagctagtggcagggctgcagtttgaatccaagtctgtcacaaagtgacaccaaaatactttggtgagcttactgggaggtgcctagcagctgtcaagtcgacttcctctcagagcccagcaggagggagctgaaggctggcctggccagccatacagctattaagacacatgccatctgagaatgggccaaccaccctccacctagacaagaatagccctgagaaactctgaagcccggatctgaagttgggtcttttttggatgctagaacaaaacattaaaaagaaaaattttcttggaagtctgtctttcaatctggaaaatgaaatttggctgcttctaaaggacaatctgttcaattgctacctctacatcaaagcttctcagcagcctccaggagcctttccaattttctcagagagggaatcagttcttgggctggaaagcacagacagacaggccagcagctggacttgggtcaccatttccccttctggggtcacctcagggctgagggtgggaaaagtgctggcatatgattgagtccctatacacactggtgtcagaacagaaacccacagggtaaagccctaaaaagtaacaccattgactgttgactgtgaactatgcaaaaatacagcagattctttagttcaatgaaatgcatttaaacacttcaaagttaaaacctgctgtagtattttgccatgatcacactcttgctccaatgcacattcagtgctttagtttctgaagctaggcactttctttcttgacatcaagttggatacaattaaatagttcattactgttatggggtggcagcataacacagttgtacatttaatgtggggtcagactgcctgattcaattctttgactctacctctcactcactatgtgacactgggtaaaattactcaattttcttctctgtaaaaatgagaaaaacaagataactgaccttgtaagatttttgtgagaatgagataaggcctataaaatgtttagcaaaatggttagtattaagttagtaggtactcaataaatattcactattgttggttttcagcaaattatttaaatagtagaattgaaattatctttgaaaaaccccactaattatttcagattgtatcagtgataaacctcaaccacagactcagaatgtattcattaaggagcctcctctccaaggcctccagtctcttaagggttaaagacaaagcagtctgcagacaacactgtggaattcaacaggagctctactgattgaccacctctgctccaaagtgctcttcacagcaaacatctctaaaagaccagtcagcaaaccgcagtgtactcatcagtgcaacatgctcagacaaaagacatcctcaaaatatctaagaaacagcgggctgctgaattctcaggactccaaaagttaagccctaaaataccacaagtccaagtgagcaatgaccactttaaaaagtacaatcttgggaagcaatatatatatactgctttctcttgtttctttttttttttttttctgcccaggctggtcttgaactcctcagctcaagggatcctcctgccttggcttcccaaactgctgggattacacgtgtgagccactgcacccagcccctttctcttatttcaaacctgtctggcctactctttagaatccaagccacaggaaagtcagtgtaattatttgaaagatatttgtcatcttctgcatccagaaggtatattccagatttgttccctttttattcactagccacagtttggaagcactttggtttgatatgaaaacttaatctacccacaaatgacaaagatgggccacaacagaatgtaataaaaatgaacatgctataggtctcaaaaggaaattctcaaattgagtctcagaaaacctgaagagtagcgttactaaaaaatttactttctccctaggtaactacttcaaagactaagctaagacaaagctcaccaatagattcacactataattagtataaacatcagtttccaatactaatagaaaatctcacagaggtagtttgcatttaaatataacaaaatacaaaaaatattaaaatgaattacattttctaatttgcaattacactcattcacagacaatatgttatagtggagaaatccctggattttaaaccagacaacacaggttcaaggcttggctaggcaaccctgggtgagtcacttagcccctttgagcctcaactgtttctgaaaacaaaataaaacaaaatgaaaacagtaatacaagcccttcctagcccacaatattttgtaactcctaaatgagacaaatataaaaccatactatatgagctaatagtataaaacagttatttataaacttttcttaagttttataagtagtttacaccaggctatgaattgaaacatgatatgttaaatacgtaaaaagtcttattattcaatactacaatattaactgaagaaccttcaataatgaacagctggccaagacaaagttatctagtaaacatcctttcaaaataattctaagaaatttctgagttatttattgaatcaaatataaaatagacattaaatagacatctgaggatgagggttttttttgtttttttttttgagatggagtcttgctctgtcgcccaggctggagtgcagtggtgtgatctcgactcactgcaacctctgcctcccgggttcaagtgattctcctgccttggcctcccgagtagctgggattagaggcacccaccaccatgcccagctaatttttagtagagggtgggggtttcaccatgttggcctggctggtctcaaactcctgacctcaagtgattcacccacttcagactcccaaagtgctgggattacaggcgtgagccaccgcgcccagcctgaggatgaggttttaaaaagacctgatgaaaaatacttcacacatggattcaagaaggcacttaaagaaaaaaaaaaaaaaaaaaaaaacaggctgggcatggtggcttatgcctgtaatccctgcacttcaggaagctgaggcaggatcacttaaggcctaagaccaggagttcaagaccagcctgggcaacatagtgagaccctgtctctacaaaaaataaaaataaaaaaatgacccaggcataatggcatgtctttgtagtcccagcgactcaggaggctgaggtgggagggttgcttgagcccaggagtaaaaggatgcagtaaaagggctagagccactgattccagcctaggtgacagagcaagatcatctcttaaaaaaaagaaaaagaggccgggtgtggtggctcacgcctgtaatcccagcactttgggaggtcgaggtgggtggatcacaaggtcaggagttcgagaccagcctggccaatatggtgaaacctcgtctctactaaaagtacaaaaaaattagccgggcatggtagcacatgcctgtaatcccagctacttgggaggctgaggcagaattgcttgaatccgggaggcagaggttgcagtgagccgagatcacaccactgcagtccagcctgggtgacagattgagattctgtctcaaaaaaaaaaaaagaaaaagaaaaaaagcagtttctaatattaatagcttcatcagatagagaaaaaatattttttccttttggactaacttatcctagactaacaaagaagcaggaaaatattctttccaggttatgaataaagaagaaaggaaaggtgaacactaaattggaattataattcagtatggtatttcagtttttggtgtcaatctgctgagacagtaaaataaaatgatttgtatttatttgatttttaaaaaccaaaataggccaggtcccatggctcacgcctgtaatccggaactttgggttgggagactaaggcaggtggatcatgtgaggccaagagtttgagaccagcctggccaacatagccaaaccctgtctctactaaaaaaaatacaaaacttagctgggcatggtggcgtgcacctgtagtcccagctactcaggaggctgaggaacaagaatcacttgaaactgggaggtggaggtagcagtgagccaagatggcaccactccactccaatctgggcaatagagcaagactcaaagcaagtctcaaaaaacacgatgcaacaaaaaaatagttattaaataaccaaaactgcacccagctttcttcattgttgtgaacacaattatatacaaatatttgctgctagagaaaaatctcaaatgtatacagttaggtgtatgctgctttgaggatgtgactattaccacagaagtacacagcatacatttccttccaaaacctgtggaactggaaatgatttaatctctcccaattacaagtacctgctttaattaactttgttaataatataactgtttacagcatcaaaattaatactgtgataacaatcaactgcttctgacagtctaaaccagcaaaacccttttggaaagcaatttatcaatgagatatacataataaaattatatatgccttttgacccaatagtcttttaacatgagaaaaatcataattaatccaggattaattaaaacaattaaaaattaaaaacaggaatagctggccaaacgtccatgtcaaaatgctaagtaaaacatccagaatgggccaggcacagtggctcacgcctgtaatcccagcattttgggaggccaaggagggcggatcacgtgaggtcaggagtttgagaccagcctagccaacatggtgaaaccccatgtcaactaaaaatacaaaaattagctgggtatggtggcacatgcctgtaatcccagctattcgggaggccgaggcaggaaaattgcttgaacctgggaggtggagaggtggaggttacactgagccaagatcgtaccactgcactccggcctgggctaatagagcaagactccatctcaaaaaaaaaaaaaaaaaaaaccatccagactgtaaaacagaatatgtttactatgatatgaatactcttatgtaaaaagatgcatgtgtggacaagggagataatgtcaaagtacagtttgtttgttttttcaaaataagcaaaatgttttatttataggatccttttgctctctgtttactctattaaaaaagaaaagcagctgggtacagtgccatgtgcttttagtcccagctactattcaggaggctgaggtggtaggactgcttgagcccaggagttttaggccagcccgggcaacacagcaagacccttgtctctaaagaaatatatacaagaagttttttaaagagacaaatagacagtttggattatatgctttgtgcaggaaaaactgtttcactagggactaaaaaaacctatcctattaaaacacaaccataaaaatgaaatgtagatttgttctccttttcagtactatcaaacaataacttacttagaaagaattcctcgaagtcagttttctccacacagctagtatacatgcgcagggccgcaatcttaatcttctagacaaagagaataaaaccaaactcaagacatgaccaagtggatgttctacttccattagacatgggtcacaaaatcttatatttcttcaactagaaggaagggtccaaaccactctctaggtaatttaaaccaatataaattttttttgttttcttagagcttagccattcatacagacttcacacaattttcatattttaggactttagcatgaaaacctcagaaaggcttttccaatatttaaatgaaatctctcatttaattccaacctacttcaccacatttgtgcctctaaatcactgttcagcattatccacattaactctttagaatctgaaatcctttatagtaaaaaagtacacattcttctggccaaaatcaaagaaatatacaaaaaccctcaagcctttaatctttcctcagaggcactactatctattctataaatctcgggggatggagtaagcggtatcttttttccagatctttaattttatagtttgctgattaacactgtgtctgtaaataagggtttctaatgactgtaaaatacaatataagaatcaaacttttactattcccaaagcactaggaattctcttaggcttttgatatgagtggtggttttaattttttcactgagctgtatacttaagatttttatattacactgtatataaattatgccttaataaaaataaatctaaaaataaattatttaagagttgacttatgggtctgaagaccaactcagcactctaggaacaggtattttaaggactttcaaaacatttcattaaggatataactaaataaatgagcacttcaacaaggcttctagaagcttattttttcttataacaacagggaaagttataaactcaaatatgcatagaccaaaaacaaatgtgtacaggctgagaatgacatagcaactgaagaaaaaccaatctagaatttagtggagctatgatactaaggtttaaagtcaccaagaacatactatacccaaaactatataatgttcatgtttttctaaattctctagagttaaagcaagtgtctctgatgggtagaaatacccatagcaaattaaagaatgattacgtctctgattgtaattaagatattttatttgctaacttgagatctgtcatgtttttaagagcttccagtctaaagttaatacaggggaaaataggacatatagaaatagacaaataaaaatcagatatccctatctggggagtaaatcagcattagaagcccacgtttaaacaaaacccatggtgaaatgctagaaaagcaaagcaaattaaacctaaaagcaagcagaaagaatgatatagtaaagatcagaaatcaacaaaactgaaacaggaagataaaatacagaaaattcaagccaggccaggcatggtggctcacgcctgtaatcccagcactttaggaggctgagacaggcagatcggctgagcccaggagttggagaccaacctgggaaacatggcaaaacgtttccatctctaccaaaaatacaaaaattagctggccatggtggtgtgtgcctatagtaccagctactcaggaggctgaggtaggaggctgagcctggaaggcggaggttgcagcaagctgagatcacgccactgcactccagcctgggtgacagagctggaccttgcctaaaaaaaaaaaaaaaaaaaaaaggaaaattgaagccaaagccgtttctttaaaaatatcaataaaattaggttgggttgtggtggctcacccacccggctcactaatcccagcactttgagaggccaaggcaggaagatcaactgaggtcaggatttcgagaccagcctggccaacatggtgaaaccccgactctactaaaaatacaaaaattagccaggcatggtggcaggcgcctgtaatcccagttacttgggaggctgagacaggagaatcacttgaacctgggagggagaggatgcagtgagccgagattgtgccactgcactccagcctgggcgacagagccagactccgcctcaaaaaaaaaatcaataaaattgataacctataaaactgatcaaggaaaaagaaaagcccaaaacacataagatacaaattttcagtatcaggaatcagagagcagacatcactgcatatcctaaagacattaaaaggataataagggaatcctatgaacaactttactccaatgaatgtgattacttagatgaaatggacaaattccttgaaagatacaaactattaaagctcactaaaataaataacatgaacagtcttgtatctattaaagaaattggatttgtctttaaaaacctccccacaatgcaaactgcagacccagatagcatcactagagaactgtactgaacatctaaagaaatgttatgaaatcagccaggcgcggtggctcacacctgtaatcccagcactttgagagactgaggtgggcggatcacgaggtcaagagattgagaccatcctggccaacatggtgaaactccatctctactaaatatacaaaaattagctgggtgtggtggtacgcgcctgtagtcccaggctgaggcagaagaatcgcttgaacccaggaggcagaggttgcagtgagctgagtgcgccactgcactccagcctggcgacagagtgagactccatctcaaaacaaaacaaaacaaaacaaaaaaaaaaagaaaaagaaaaggaaaaaaggaaatgttacgaaatctacacaaactctgccagaaaacaagaagaaaggatatttcccagctcattcaataaggccaaccttatcctgatatcaaaatcaaagtcattaggagaaaacaaaactacagaacaatagccttcatgaacatagatcattgatgcaaaattccttaagaaaatattttaaaattaaatccatcaatatttttaaaaggatagtatatcataatcaagtgaaatttatcccaggaatgcaaagataattcaacactgacaaatcaatcagtttcaccatatcaacagaccaaaaaaagcctgtttaattttgttaacacttgcagttctaggaagtatctgaccacagaacacatcttgggaagcactggtctgtgccattaccaaactaatgataatctaataatatcatgatcctaataatttggccttgacaggcctactcctatccttaagacagggagttcaggacatctgccctagctcctcacttcatccaataattcactgagtacataactcagtgcctggcactgatctggatgatgagaatagagcagtgggcaaaacagacaaaaatctctactctcatggagcttacggcccagttcagctacagacaagtatgtaactttaactaaaatttctaatcatctatttcttgatttttttaaatcttgtaatctccttcagattcctatatataaagtcctgggttcataattaatcaccttgcctggagacttgccttcaaggcccaaggcccaagtctttccttgagaaggaagcttccccaacaacacgtttgtgaaaaagcattcatcacaaacaatgaagacttcaccagattggccagagtatgttttcagtgctcatgctatggcaatcaggagcattttatagttcttcacttttcctgctgcaaggccaagcctttatacttgggtgagccattttcctggacaaatctctaaaacaagtctctaaagactatcacacagagactggaaataataacttgaggaaagaacctcatcaagaatcatgcactgatctgagttaaggacgtagggggactgaattttcaaccagtcaatacaagttgttctggtccttggatgacttcatatttatttcattttaattttagaagacttcatcagtcatcttttacttgagtaaaagagaggcaccttgaacagctttaggaaatgaaaatctgctctcccacgaactaatgcattttttaacatcctacaggatgaaaaacaaatctagtaaaatgcttgcattaacagctatgtaagagtttgaaagggcctggcaaggtggctcatgcctgtaatcccagcactttgagaggccgaggtgggcggatcatgaggtcaggagttctgagaccagcctggccaagagaccagggtggccagtatgatgaaacctcatctctactaaaaatacaaaaattagctgggcgtggtggcaggcacctgtaatcccagctactcgggaggctgaggcaggagaattgcttgaacttgggaggcagaggttgcagtgagccgagatcgcgccactgcactccagcctgggcgacagagcgagactccaactcaaaaaaagataaaaaagagttagaagggtgttttaagtaatttgaaccttctattgtctactggaaatccttctacagcattcttgattcacagtcaaccatctgggcctctgttcaaacaagaccaatgaccttgtaaggctacctgtcccacctgaggacaattcttgttagattcttattttgctaaacttaaaatctgcttcatataacattcattgaacattattctgcccactggaataccttctttttttcacatttgcccctcaaatacctgagaagaatcatcctgtcttctcttttccaggctaagcatccctatttccttcaaccgttcttaacagtttctgaaatgttcataaggctcactgcctacctctgaatacattccagtttgtcagtgtccttcagaataggaataactttttggcttaatgctaatatggaaacctattctatggcatgtggctgagttgggtaaatattgtgcttatctcacctgatactgcatataaaggtaattttttaaaatgatgattccaagatactcaaataggtaagggaaagctacatttaagatcctaaacatgattatcaaacatgggaataacacatgaaacctaaagaaaaagatagagaaaagatagctgatactgctgatgtggacagacatgcaggtattttactccctaatcaaatacatgtgaaaacacaaaacaaataattttgccagtgcaatccaatacaagtgcattgatttgagtcaacattgctgaaaacggttctgtttttcaaaatgaaaagttacacatacattttcacatctcaattacactagaatgtcatacgttgatattgtgatgtaacaaattttaaaatgaaggttataggctgggcgcagtggctcaatcctataatcccagcactttgggaggccaaggcaggcggaatcacttgaggtcaggagttggagaccaggctggcccaacatggtgaaaccccatctctactaaaaatacaaaagtcagccaggtgtggtggcatgcgcctgtagtcccagctacttaggaggctgaggcaggaaaattgcttgaacctgggaggcggaggttacagtaggctgagatcacgctactgtactccagcctgggtgacagagtgagactctgtctcaaaaaaataaaattaaaattaaataaaataaaatgaaggttatagaaagtacacaccatcacatcacaagagttttaaaatgcaaacattagggatttagttgatgtcacaagggaaccaagaaaaatcagaggctaacttaggctaaaagagcaaaggaattttcctgatgatttagtaatcctccaaatgatagccaattttctctctagaatcattaaaaaacagcctagacaaaacatatggtagcaaccaagtggaacccaatcaccaagaaatgaataaaactgtaaatgtttcttttcttttttttgttttgacttccctcttaatttctaattttcaaacaaaacatatactttaagtttgtaaatccaaatgccataagcataacatttttttaataggggaaaagattctggttaaaaacattaccaagtatatcaacaattatcaagtgtcaaaaattaagatattaaaaaatacaactttaaagaacataactaatatttcattggcaattaagaagatacttcataaccttagggactcaagaacatcattgtcagtatttgtgttctttctatattttttcaaagctccttaaaaacaaaatgcttgtggaattactgttcacttttcagaattcaggtaaaagagtaattatagagagaagctcatatttgctgtagtgagaattgttagaaagagaaccagacaccataagaagaaaccacaagtagaagtctataataaaattgaaattctaatttgaatccaacttgttaaaatggtgtaagtggcattacttggttgttctcagtaaagcttatatattttctagaaaaatcttccctactgctttgagtgggcttgctttgacttatgactgattaggcttacccaatattccagcaaccctgaaaggcattaaaaggcacttctgccatagtgaaagagagaaatggtattacaggttgagtattccttatctgaaacgtgtggaaacagcagtgttttgaattttggatttggggggattttggatgctttgcattatacttaccagctgagcatcccaaatccaaaaatccaaaatgctccagtgagcatttccctggggcatcatgtctaaaaactccaaacgttttagattttgaatttccaattttccaatttgggatgctcaacctgttctaggagataagtgggctgagaagaactgaatcgctgatgttttatttctataattggttagaggtattattataaaagcccaggggcagtatgcatctgaggcagagaggacattcattcatttatagccactactattataacagataatgtgctaggccaagagttgactgggagtgacatggttaacaaatatccctccataataagaattacaatagatcgtgggcttaattagttaataaaaagatgattagtaaaattttaaagaaaatcccttataaaatatgggtccatcagaaagtaatgcttccttaagaatgttgccaatcagaacatttggcccatctgacccctcagaagtcatctatatggcataccatgcagcaagggcctggaaagcccagtcttgttgccatgcctgctactatgagatgcttctaaggaatcaggtggagggactagttcagccccacatgttgtatagatctgactggaagcagcaagaggttgtggcacgtgggcaaagatattttgaagaagttatcagaataatgtatggaccttgagagcttacttgggaggttctggcaggggagtgcagctactcatatacccttgatcaaagaatggtcctcctctattggagaaggtcatcctcttcaaccaagaacacagcttcaaaaaggtcgcacatagagtggtcaaggaggaaggggacacccgcctacccagccagatcagccgaatcaaccctggtgatcaatggggtgacagatgtcgcagctagatcgtcctcacatccaaaataatgtatgaattccatgaaagcaaagcagaagctttaaaaaatctattaggagcagaaagcacaatgcccaaaaggaaaaatgagaagaacttaaaggactttacccatttactgtatttcaaaggtcccgtgaatcccatggcttctattatctttgtgaaagcaccaaccttctcctcaacaggctgtggggaatctttggtagtagaaagctgattaaccaaaaagaaaaaaactaaaattagttgcaaaaaatttttaatagaatgctttgttcctcatcaggtctgagagcattttttttttaaatacagtcagggtctcctcccctcacccaggctaaagtgaagtggcacaatcatagctcactgcagcctcaaacttctgggctcaagtgatcctcctgcctcagcctcccaagtagctgggattacaggtgcacgccatcacgccaagtcaattttttaaattttctgtggaggtggggtccacagcctgttgttctctggagagggggggtccatagcctattgcctaggctggtctcaaactcttggcctcaagcaatcttcctgcttcagcctccccaaatgctgggattacaggtgtgagccaccatgcttgggctgagggcatttttattgcttagatttttgttttcacctacaatttttaattttcttttttttttcttttttcttttttttttttttttttgagacagagtcttgctctgtcgcccaggctggagtgcagtggcgagatctcggctcactgcaagctccgcctcccgggttcccgccattctcctgcctcagcctcccgagtagctgggacaggcacccaccaccacgcccggctaatttttttgtatttttaatagagatggagtttcaccgtgttagccaggatggtctagatctcctgaccgcatgatctgcccgcctcggcctcccaaagtgctgggattacaggcgtgagccaccgcgcccggcctaattttcatttttttaagcatcttatcattcagtgaaaacacatttggaactgtacctaatagatgccctccaaatttcagagcaagacatgcctacctcattgactgtatgtctattaacccatatctagcagatgacagatgtggggtattagaataaaagttctatcaaaaagaagacttttaaaaggaaatcttgacccccatctcccaagaacaattctgagaagtaaaacattctatgcttattgatgtaataggaaaaggaaaaaaaaatactgcctgaaagcagtcaaaagtcattcaaaactgcaatcaagcactgaatgtttttaaactcttgcattttttagtaaaggtatcacaaattttattaatgactacagagtcttgtagtttgcaaataacctccaaggaaagtctgttctaatgttaaccctctccaagcaaaggcaagctatctaaccaataaaaaattatccaaaagttaaatatcactttatttttaacatgtaaaaaattcatatgttttcctcttaagtgttttccagacacaacaatggaagaaacataggacatagcctcagaaggcttaggtccaaatattcaggctggcatggtggctcacacctataatctcagtaatcccagtactttgggaggccgaggtgggaggatcacctaagcccaggagttcaaggcagtagtgagccatgatcatgccactgcactccaccagggtaacagagcaagacctcatctgttaaaaaaaattttaaaaacaatcccagcacttagggaggctgaggcaggaggatcgcttgaagccaggagtttgagaccaacctaggtaacaaaacgagaccctggtctctacaaaaatttaaaaattggcagtacacagtggtgcatgactgtaagtctcagctattcagaaggctgaggcaggaggatagctcgagcttgggagttcgagactacagtcagctatgaaggcaccactctactctagcctgggtgacagagcaagaccttgtccctgaaaaaaaaaaattcattttgtctgccacttacttaccatccttgtgaccttgggcaagtcactttaccccctgagcctcaccttctgcattcgctaaaactcacctagctaacaattttgttgagatccaaagaacacctgtgtgaaagcactctataaacacagaatgcactgataattctcaccttacgtgtggtgtgatacttcctattcagctgtatgtctattccaggaatctgttctgatccaccacatgctcgggactggctcatctggggccactgaagaataaaaacacagatctatgcaacactgagcacttacagggttaatctgaacagagctgtttcaaagtaaagactataggatctttccaaccttacttagcccacttccccgtgatcagctcaccaggaagacccaagatcagcacctagaagggtgtctagtacatggtagatgcccaagaaatatctgttgaatacctgaagaaataaaagaatttgggccaggcacaatagctcacacctgtaattccaacactttgggaggtcaaggtgagaggattgcttgaggccagagtttaagactcagcctggggaacatagcaagactctatttctacaaatttttttttaattggctgggtgtggtggtgcatgcctatagtcttaagctgcttgggaggctgaggtgggaggatcacttgagcccagaagatcgaggctgcagggagctatcatcacaccactgcacttcaacctgggcgactcagcaagagcaagaccctgtctgtaaaaaaaaaaaaaaagagagagagagagtgaattcaaaggccaggtggcgtggctcacacctgtaatcccagcactttgggaggccgaggtggatggatcacttgaggtcaggagtttgagagcctggccaatatggtgaaaccccatctctactaaaaatacaaaaaattagccaggtgtggtggcacatgcctgtaatcccagttactcaggaggctgaggcaggagaatagcttgaactgaggaggcaaaggttgcagtgaaccaatatcatgccactgcactccagcctgggcaacacagcaagaatcggtctcaaaaaaaaaaaaaaaaaaaaaaaaaaagaattcagccctggaaacctggaactacatctaagtcaattctaggaaacagaactgtagtatctatctatttaaatatgggcagcagtgccgtatatggggaaaaaaataaagacaccagccacttttaggtttaaaacctgcttctgtcgcctacgacaagctcagtggccatggaaaacttactgaacctcagttgcagtaaggatgaaagaaggtaagatatataaagtgcctttcacaaaataggcactcaataaatagcagaagtttccatcatcactatcatcaccagcattattgtttggatcacaatcgccacctttttcatgttcacattgcatttaaaaacaatttggcaataaaatagccgttattatgtgccagatactatacagaatgaaaactgggaggaaagtccattaaggagatggttaatgaaagttcagtcactcagtggaaaatcaggtatccattgagggttttttgttttgtttttgttgttgttgttttgtttttgttttttgagacaaggtctggctctatggcccaggctggagtgcagtggtgcaatctcagctgactgcaacctccacctccccggctcaagcaattctcctgcctcagcctcctgagttgctgggactacaggcatctgtcatcacaccctgctgatttttgtatttttgtagagacagtgtctccatatgttgcccaggctggcctcaaactcctgggctcaagtgagtgatcttcctgccttgaactcccaaaatgccttgaactcccaaaatgggactacaggcatgagcctgggtgcctggctgggatttttttttttttaaatagacttttttttttttttttaacagcagttttaggctcatagcaaaacttcctggaaagggcagagttcccacataccccttcccccacatgcacagcctcccccgccatcaacatcccataccagagtggtgcatttgatacaaagaacaaacctacactgacacatcatcatcactcagactgcacggtttactcagagattattattattgttaacaacatgaaaaatgttaaatgcttataatatgtataaaattataggtaaaacatgactgcgtagactgcatatgggcaagtttagaaagaacacacaagaaaccaaagagttattttgttaagttagaattatggataaatttaagaatctatagccaaaataattctggcaaaaaaaaaaaaatctagtttccaaactctcactaatgctatattacctttacaataaaaaagggtgagagggagcaggaagagggctgactcttcaattctggtttattccaagaagaaatggaacacatggaatgaaaatgattttttttctttaaccctaacgaagaaaaaatagaatttctaattgtggaatgttactatttacttttctttccaaacgaggatattaaaaaattagtcaggattcttctggtcagtcccaaggacacttaggctttaattcataagtatcaagcaggctttgtaaaacacagactaaacacagaacacctccccattacatcacatacatcaatgcaatggtccacctaaaacacaaagcacttaaactggttcaaagaacacagccaacagcagtttccacaagctgtgctttgggctgggtcctcttctattaggttctattagatccttctttttcctcacagctctaggagtaaccagtagattccttctgtggctgtcctaccatctactgtatttctatcctaccattagctaacatttcacactatattgaactactaaagtacctatgtatctagtatcaaggacatctagtttctccacacctacacacttataaacacacacatttacttttttgtactacccactcttgtccttgcacttcccgcaaaaaattcactcgacccttaaagacctcaatttttcctttgcttagattagaaaatatcaataggctgggcgtggtggctgacgcctgtaatcccaacactttgggaggccgaggcgggagggttgcctgagtccaggagttagagaccagcctgggcaacatggcaaaccaccatctctacccccctccaaaaaaaaacaaaaattagccaggcatggtggtgtgtgcctgtaatcccagctactcaggaggctgaggcaggagaatcgtttgaacccagaaggcggaggttacagtgagccaagatcatgccactgcactccagcctgggtgacagagcaaggctctgtctcaaaaaataaaaataaaaaataaaaaaacaagaatgacagaggcagagaagtagaaagggggtgctgggacaaactcaagcgattcttgaataccatgggcgtgtgtgtctgctccttttagcaactataagctccagggcacagcccatcttatatgtctgtcattttctgtcccaatactcaacaccattctgggcatgaagtcattactcaataaaaactaggtggattttttttttttttcaaagaggacaactttggagaacgtccaaaaaaagaaccacaggaatgatcaaagggatgaataaaaggtcctagtggaaaggtcaaaaggaatttaggctgtttagcttggagaaaaggcaactgaagaactaaagagtaactcagaataacaacacttgagctggaagaaatctcagagatattctggtccaaccttttcacttcacagatgaggaaactaagacaaagggagaggttgcaatttggtaaaggtaattttaggacaacttttttttttttttttaagtttcatttcatacagtgaggagaaaactttcccaagcaacaggaacataaatagcaacaaaaatagcaattgcaacttactgaagatctcctgtatgtctagtacctacctacatgcttggtgttttacttatgttatctcacaacaatcttataaagtatattttcctattttttttttttttgagacggagtctcgctgtgcccaggctggaatgcggtggcatgatctcggctcactacaacctccacctcctgggttcaagcaactctcctgcctcagcctcccaaatagctgggattacagacgtgtgccaccacgccagctaatttttttatttttttagtagagacagggtttgaccacattggccaccctggtctcaaactcctgacctcaagtgatcagcccaccttagcctcccaaagtgctggtattacaggcatgagccaccacacctgccccttctatttctttttttctttttttttgagacagggtcttgctctgtcacccaggctggagtacagtggtgtggtcatgggtcactgcaactttgacccccccagactcaagggatcctcctgcctcagcctcctgagtacctgggaacacagagatccagctattccggattttttgtagagatagggtcttgctatgttactcaggctggtctcaaattcctggcctcaaacaatcctcccaccttggcctccagaagtgctgagattacaggcatgagccactgtgcccggactattttttcctgttttagaaattagaacacaaaggctcaaagaagtaaagttcattaaagactaggatatatactcaaagctatgttctgtccgctatatcaagctgccttcaaaagtctgagtagagttcaacaacacaggctcatgcacacttaatacccagatcttgatttctaaatactgctctccaatagaaggaatcggggctgggtgcggtggctcatgcctgtaatcccaatactttgggaggctgaggcgggaggatcacctgaggtcaggagttcaaggctaacctggccaacatggtgaaaccccttctctactaaaaaatataaaaattagctgggcgtggtgtgtgcgcctgtagtccccagctactcgggaggctgaggcaggacagtcacttgaacctgggaggtggaggttgcagtgagccaagatcgcaccactgcactcccacctgggcaacagagtgagactccatctaaaaataaaaaataaaaaaaataaaaaaataaaatcaggactccttggagtaatgtttgaatctagggccagggcaaagaaaatacagcatgaacctgaaacatcttgtggtgccagcaattaagagagtattcaaaaaatgatggggggcatgtagaaaggcgttcccaatagcccaagctgggacaatctaatcaacaaaataactaattggaaaatgaattataagccgggtgcttataatttgcacctctctttgggagaccgaggcgcatagatcacaaggtcaggagatgaaggccatcctggccaacacggtgaaaccccatctctactaaaaatacaaaaattagctgggcgtggtgagctcgcacctgtaatcaagctattcaggaggctgaggcaggagaatcacttgaacccgggaggcggaggttgcagtgagccaagatctcgccactgcactccagcctgagtgagagagtgagactccgtctcaaaaaaaaaagaaaagaaaagaaaagaaaatgaattataactcagaagaaaataaatatccatgagctcatactggtataaataaataattgaataaataaataaatggggaagaagtgacagctctttcttacaacagagttccagttaataaatgtaggaatgatggaaataaaaaatcattagacaaacaccacaataatgatcactgcagtgaagaaccatcaatgcaattatcatataatccatcaatcctaattctgggtatatatccaaaagaattcaaagcaggatctctaagatatttgtacactgacattcactgcagcattattcacaataatgtgtgcaagagacagaaggaacccaaatgtccattgatccaaatggataaagaaaatatacaatagaagagtacgcagccttaaaaaaagaaggaaatcctgtcatgtgctacaacatagatgaaccttgaggacattatgctaagtgaaataagcatgtgccagttataaaagaacaaaaactgtatgagtccactcacatgaagtatcctaaagtagtcaaaatcacagaaacaaggccagggtgatggctcatgcctgtaatcccagtgctttgggaggctgaggcgggcagatcactcgaggtcaggagtttgagaccagcctggccaacacagtgaaaccccgtctctactaaaaatacaaaaattagccaggcgtggtggtgagcacctgtaatcccagctactcaggaggctgaggcagaaatgcttgaacctgggaggcggaggttgcagtgagctgagattgcaccactgcattccagcctgggcgacagagtgaaactccgtctcaaaaaaaaaaaaaaaaatcatagaaacagaaagtagaaaagcagggtggggagagaattagtgtttagcatagagttttgcaagatgaaaaagtttatagagatctgttgcaaaacaatgtgaatatgcttaaattaacattactgaactgtacacttataatggttatgacaataaatttaatgttaacatatcattaaaaaaaaccaccaatgactgctaaaattagtaagcaaaagtataatgtgaaatgggtatctgcacagtctccaagtatctcctgacaagatactaattacaaagggaaaatactaactttagagttcaggaacctgacaaacaccaatttaaccaagtggccaaagttataagacctactagcattatgtatcccctgatatgatgcactgagaagggaataacatcatttttgccaaaaatgcataacctcaatctcattataagaaaatattagaaaggccgggctttctatattataggtggtagctcacacctataatcccagcactttgagaggtcgaggtgggcggatcacctcggatcaggagttcaagaccagcctggccaacgtggcaaaaccccttctctactaaaaatacaaaaagtagctgggtgtggtggcgggcacctgcaatcccagttactggggaggctgaggcaagacaatcacttgaacaggaggcagaggttgcagtgagccaagatcgcaccactgcactctagcatgggtgacagagcaagactctgtctcaaaaaaatgaataaaaaataaaagaaaataaagaaaaaagaaaagaaaatattacacaaactcaaattgagaaacattctacaaataactgactagtactcttcaaaagtgtctaaatcttgagaagaaaaagaataagaaaatgtgaccagacacagtggctcatacctatattcccagcacttggggaggcccacaggggtggatcacttgaggtcaggagtttgagaccagcctgttcaccaaatggtgaaaccccgtctctactaaaaatacaaaaatcagccaggtgtcatggcacatacttgtaatcccagctacttgggaggctgaggtgggaggatcgcttgaacccaggaggtggaggttgcagtgagcaagatagtgccactgccaagatagtgtcatccaccctggacgacagagtgggactctgtcttaaaaaaaaaaaaatgaaaatttaacagattggagacgactaagaatatatgacaactggatttgttatcgcagatcaaaaaaggacattcataaaaaaaaaaattgacaaaattggaacaaatagactaattaatagtattatttcaatgttaatttcctggtttcagtaattgcaccatggttatgtaagaggttaacattaggggaagccagatgaaggctatttgggaatgctactacttttacaactcttacataagtctaaaattatttcaaaatttaaaaaatatttttaagtagacagaacttcaagaggctaattaagacaaagctgaaagtatgtctctagctctttgaaaacaataataggattacagcactggacattaccttacagatacctgatactaccactcatcgaaggaaggattcctttatgtcaggcccttgacatacattcatcctaccactgcctgaatatttccagtaagagtaaatttactatgtgaaaacgcagctcacacatcccattatgcacaattctaattaacaaaactctttctcattctgagccaaatcttcctccctgtgagacatgtacctgaggatgccattctgaagcagaagtttccaaccaggggacctcaaagataggaagatactccagtaagttacagtcgatacgacaaaaggtccagttgatttacaatgactaaaattacatctggtcagcatgagataaaccaccctcagttatttacataaatgctttgctataatgttgtcccagagcctaatacagtacccggtacttattaggtgctcaagaaacgtttactgacccaaagagtagggcacaagtcagagattcatataatgagttattttcccctaccatctacacacatacaaataacaaatactattaaaaatttgtacaaaaagtaacagaacacagcccaagctctgaaaagaaatacctgcataactacccaaagtagacgcctcttctgcacaggcatattctccattcattcaacatatacttagtgactactctgtgccaggcatagtgaaaagaccaggaaatacaagaaaaaagcaagatgtcctcagaagggcagggcttacacattaattggagggaatttttaagtagattatatatgttacataaattatataatatatataattacatatagcaaacatatttttaattgcatcgaatacgaaaaagaaagttaatgactacagataaaaatcataaattggtaagaaaaatgagttcccaatagatgaatggagaaatgccataagcatacaattttcacaaactgaaaaacaactgatcaatacagaaaaaatacataaccctgagagctaaacaaagaaatacaaggtaaaacaaggtaacatttcttacccaatttatttaagttaaaaaaaactcaacttgagagaggtaataatgaaaaactacttatacatacattgctggtggcagcataaattaaaacaaccttttgaagaggcaaactgttcatactctgacccaaggtatgccttcctaggaattattaataagtaattaaaagtaagaaaaaatatgtgctaagacaatggtaagaaaattaaagcttataatggcaaaaaaaaggaaatgattttcatatcaaaggctaagtaaataaaatattatatggtcattaaatttttaattacaaagtctatcaaaacaatatgaataatgtccactctaataagtgaaaaggtaccagaatataaacttctgtggacatttgttagggtacttcaggaataacattacatatacatacacacacacacacacacaaacacacacaaacacacacacacacacacacacacacacacaggctgaaaaagaaccagcagagataaaatactgacgttttcagatttgaagtcatagatgatttatttcccttattactaaattatttgtattattaacaaaaatcaggagggacacaaggtccaaggtaaactacattataatgattaggtggtcaatggtaaatgaatacctcaaataattgtttcttggattttatattcatataaaggaaaaagaaataattatcacgcccaaataaaagtagcacaagatggccacaaaaagaaaattgaaaaaggttaactcggagatgaatatctggaaaaattccctaacagtaaaaatcatcagactgtagcatggtatcctaggctaagttccactgctagggtatttagaagcaacgccctagacaccatactttaggaatcagtcctaagttggcaccacagagacccagagtggtctcatgaggtttttccatcacacaatttggttggctaatctataaatacatgacatttgcacataaacactaaggttttcatactaagcaaaagaacaacaaatcttacctgggaagtgcgagacagagccctgtccccctgtccttgggtaggagacacaggtatcaatcggctgcatactggaacccactgagaaatgctagtctggttcctctaaagaaagaaaataataatctgtcaggaatctaaatcatactccctacatggaaggcaaagagtgtacctgtgatactgtaatataattagaaatatatatttggccttcatctctagttcctggcacagagctcctaaaacccttggaatttctgagtgaggggggtgtctgtaactcataataagcccctttcaaccatacctgagtttatgctaatgaggtgattcatgcaggatggaggctggttgccagagaaacctaccacaggagtagagggttggaactcagccccaactcctcaaggcatccccacctccaggagaggagagggattagagactgagccaatcactggtacccagtgatttaatcaatcatgccaacaataagcctccacaaaaattctaaatgacagagttcagagaacttccggtaaagatgaaaaactcttttttctatactcaacactccacttctgataccaaatgtgcaggggcaaggggtctccataccaagcaattctctagttctctgcagacaccaactgggtgtcctacaatttaacttaattcttaaactaactgcctggagttagcagagacctcacagcaccatccaacaggactgtcccccacttcagactcccatcacaagtagtgggtccccaggttactcacacttttgtccaacttgtccatacattgggggttcccacagctgcctcctcagattcaataatttgctagcatggctcaactcggggaggcacttcacttacttttatcagtttattataagggatacacctcaggaacagccaaatggaagcgatgcaaaagacagggtacggggtgggagcttgctctccgggtgtgccaccctccctacactttgatgtgtttactaacctagaagctctccaaacccagggatttctatggaggcttcattacgtagacatgattgattatcactgatcactggtgatcagctcaatctccagcccctctccccttccaaaagtcagggaggagtgggagaagctacaagttccaaccttctacacacatatttgttcctctagcaaccagcctctaccctccaagagtcaccttattaacataaactcactgccggtcatagcagctcatgccttcactcctattatctcagcacttttgagaggctgaagcaggattacttgaagccaggaggtcgaaaccagcctgggcaacaaagcgagacccccagctatacaaaaaaaaacccataaactcatgtatggttgaaaggggcttattataaataaataaaaaaaaaaccattcctctcaccccaatcactctgcaagggtttcaagagctctgtgccaggaaccagggataaagaccaaatatatatttcttctctcacaatatcatatctgggttgcagccacaggccaggagggtggcacactctaattccacagggacagaagcaactacactcaggaccattccagatctggcctttagtacctaagtttaaaaatcctgccagaatggggtatcacatgaatgaagaacttccaaaatgggaccaagaccaagcctccacatgctcatttctccaaggataagataaaccactgcctactactgattccacagactaaaataattctggtaataggtgactcaagcagtgggcacgggctccctctgggaagagaaacaaaataagcagacttctggcattttatgattagattataattcaaattacggtttgcaatgtcttttttttttttttttttttttgaggctgagtctcgctctgtcacccaggctggaatgcagggccatgatcccagctcattgcaatttccacctcctgggttcaagcgattcttacgcctcagactcccaagtggctgggactacaggcatgagccaccacatagggctaatttctgtatttttagtagagacagggtttcaccatgttgaccaggctggtcttaaactgctgaccttaagtgatctacctacctcggactcccaaaatgctgggattacagatgtgagccactgtgcctggcctttttttttttttttttttttttaagagacagggtctcactacattccccaggctggagtccagtgcctagtcatggtgctaacattgcacactacagcctcaaatgcctgatgcctgggctcaagtgatcctcccacctcagcctcccaagtagctgggactaaaggcttgcatagctgtgcctggcttacaatgtgttttcataaacactgacttacttacctgatcttcatagaatccctttatagtaagcaatgctgagatcatcatcatccccaaaaggaggaggaaactagggtagaagttttgcagtgggaaaacacacgtgggcaacttgatttccaagacaagagagattaaatggctgttcaagctaaaactgagattcacgttttccctctaacatgaagctcacttcagaaaggtctcttggccaaagtgagaggctaggctggagaaagggatagctctctcttgctaaataagaagtctgctttattttatgaacctgaaatacattccactgtataaatgatagccatgtacacagcactggaaatcttaattttaggaaccaactctagggatctgagggttttcttcacttgacctgtagaccttatagggccataatgaggaccagatacataaattgcttgaaaatcctttgccaagcataatgtataacacagtcagccctccacagccatgggttctgcatccatggattcagccacccacagattaaaatattcaggaaaaaaataccgggcatggtggcgtgtacctgtagtcccagctactctggaggctgaggcacgagaatcacttgaacccaggaggcaaaggttgcaagtgagcagagattgtgccactgcactccagcctgggcgatagagagggagactctgtctcaaaaaaaaaagaaaaaaaaaaaaagaaaaatcaggccgggcgcggtagctcacatctgtaatcccagcactttgggaggccgaggctggcggatcacgaggtcaggagatcgagaccatcgtggctaacacagtgaaaccccttctctactaaaaatacaaaaaaattagccaggcgtggtggtgggcgcctgtaatcccagctactcaggaggctgaggtaggagaatggcatgaacccgggaggcggagctggcagtgagccaagatcacgccactgcactccagcctgggtgacagagcgagactgtctcaaaaaaaaaaaaaaagaaaaaagaaaaaaaaatcaggaaaaaaacatgccatactaaacatgtagactttttttttctcgtcactactccctaaataatacagtataacaactatttacatagcacctatattgtattaaatgtaagtaatctagagattatttaaagtacatgggggaatatatataggttatatgcaaatactatgccactttgtatcaaggacttgagcatccacggattttgctatccgagggaggtcctggaaccaaaggaccagggatacttggggacaattgtactaggagtcaaagattctagtttaaattcagctactctaacattatctttacaagtaatttaacctctgtgacattcagtttcctgatagcaattatgaggaacacttaatgagcatttgatggcaggcacttttctggtactttacatatatgaactcatttaaacttcacaatcaccactcatgtaggtatatcattatcccatttacacaaaaaaggaaactgaggcatggagaggataagcaacctcccaatgtcacatagttctaacagcaggattaagatatgaacccagacaacccaactctagaatccttgctcatttatgggatgaaagggtagagtatctgcaaggtaccttctagctctaacactatatgacctggtctggaaccaattaaaacagcatattgtggaaagtgccacataactaaaggcaggaagtactgttcagaagctacatattagataatcacctctgtgagccttggttgtctctttttatcaaaaataaagacaaaatccccacttctcaggattttctttaaaattaacaaatgtaccttgcagtatgttcagcacaatattaagttgaatctgaatctccatttcctcgagtagaaacaggttgaggtggggtggagaaaggcattaaatttttaaacctacagatgctttctaaagtgtctcacagttctaaaattgtataattgccacttacagcaccttaaatttcaaatgaaaagtggagctaaaaatattttatttgagctgtggttggatcagttgaaatggttttccaagtgagagacagttactggtgttttgttttacaaacactgacagatttaccagaaacattcaatgtcagatgttcctgtactaaaaatgttaactatgggataagaggaaactgcttcagattcagggccaaaggtggggggggggggggggcggtgcagggggagcaagaggaaattacaagttgaaacaatgcaaacttttggaagattttctgaagaatttcatcatgtaatttccaatgtcaacaaaacttttctctgtaattttggctccggttggtcttaggccaatacttttaaatcagttcttattagaagaaaggaacaatcagctgttctttccttcgccaatcctacaacaattcttgtccaaatccttaattgaaaccactgaagtgtaacagaaagggtaatcccaagtctgccatcaaatagctgtgaactggttactcaacaatctgggcctccattttcccttatgaaaaatgggaataataaaagctatctcacaggagtgttcccaggaacattcctaaaagcactttgataacagaaaaacacaactaaaggcatcactgttatgaacaactgttaccgaattatacaagccctgctttccccagcaaactgccagagaagcaaaaactgttttcttaaaatattgtttggaatctggcatttattccctttctcaaaagcttgcagtggtttccaaggacctctttattgaaacttaaacacctggtccttactggtctttaccaactggacccctctaaactcataatacttactgtgttttccactcaacagtttcaacacctgactcagattctctggtttgggaatcactgcttcactccacacatgctaatttccttgtagtaattttttgggactctcctcttcactccaacccaaactataagctcaattgcttcaagaaatctctctaggccgggcgcagtggctcacatctgtaatcccagcactttgggagaccataggcgggcagatcacctgaggtcaggagttcgagaccagcctggccaacatggcaaaaccccatctctactaaaaatacaaaaattagccgggcgtggtggcaggtgcctgtaatcccagctactcgggaggctgaggcatggagaatcgcttgaactggggagacagagattacagtgagccaaaatcaggccactgcactccagcctgcgtgacagagcaagactccactcaaaaaaaaaaaaaaagaaaagaaatctgtctagatgtcagcttctggttctactggctctactcagtccttttttttttttttttttgagatggagtcttactctgtcacccaggctggagtgcagtggcgcaatctcggctcaccgcaaccttcacctcctggattcaagcaattctcctgcctcagcctgccgagtagctgggactagagcggcgcgctaccacgcccagctaatttttgtattttcggtagaggcggggtttcaccatgttggccaggctggtctcaaactcctgatctcaggtgatccaccggcctcggcttcccaaagtgctgggattacaggcatgagccaccgtgtcgacctctactcgtcctttttcctttccacctcttccaccacttcatctataaatataaatctgtggaagtacttatctctctcttaaggtactaatatattaggcctataacaattagcacatctcaacttctcccaagttcaaaagacattcatagccactcccaatggcaaaaattattcctttaacttaagataaatgcactgttactaagtgagaactagttttattgccattttgcctttccaacacttcaaaaccaaaaaaaaaatttttttcttttttttttttttgagacggagtctcgctccgttgcccaggctggagtgcagtggtgggatctcagctcactgcaagctccgcctcccaggttcacgccattctcctgcctcagcctcccaagtagctgggactacaggcgcccgccacctcgcctggctaattttttgtatttttagtagagatggggtttcaccatgttcgccaggatggtcttgatctcctgaccttgtgatccgcccgcctcggcctcccaaagtgctgggattacaggtgtgagccaccatgcctggccaaaaccaaaatttttaagataggcttcatgttttcgtttcccgtgcacattgttaattgcagtgatttttacatcagtatttcaaaacattctgacataccacctcttgtactgactaccctttaatcagtccactgacaggcctgtttctgcatgtggttttttaagatacatagtattttccttggctcattcatgagctagaaaacaatttacaggtgtagcggattctagttattcaccataaaatcaccacaaacactgagttagcaaatactgaaccattgcttctaaaggaaatgccagacttaggttcctggaagcctctggtcacaacattcatcaaccaatcaatatataaccttgttttattggtttctgttgaaagacaccctatttaatatacattgttgattcattaacacggaactcacagccaacagcactataactcacttagcaaaatttacctaacaaacatattttcccataaggcacattgtggccttctcgcactcagcaatgctagatagcgtttccatactacacttgggtgacattttaaagatgggattcaccaacaaaagcacaaaaatacgaaaaatatggcactaaacaggccatgaaaagaatacttgttacagtatgaaaactgaaacaagaaggcggaatgttgacccatctcagccaggaacacacacattggcagctcaaatttcttacccctctgcaaatgtccacaagtgactacaaaagtgctgcaagtattgattttggggtttcaaataaattttagcaactaggtgagttcacaaatatagaatctgtgaataacgaaaatcaattataaacatgaaatccaccttttttttttttttttttttgagacagagtttcactcttgttgcccagactggagtgcaatgacgcaatctcagctcaccgcaacctctgcctcctgggttcaagtgattctcctgcctcagcctcccgagcagctgggattacaggtatgcgccaccacgcccagctaattttgtatttttagtagagacggggtttctccatgttggtcaggctggtctcgaactcccaacctcaggtgatccctcagcctcagcctcccaaagtgctgggattacaggcatgagccaccatgcccagccgaaatccactttataagtcaccactggtgcctatattccaaatgccatggatactaactcaattccggagtccaaagaacagatactacggtaacaaactttccttccagttacaatgtggcatgctataatacaaaaggatatttccacagagggaagaagagaatgtttaaccattccttcaaaaattactgaatacaggccgggcatagtggctcacgcctgtaatcccaacactttgtgaggctgaggtgggtggatcacttgaggtcaggagttcgagaccagcctggccaacacagtgaaacccgtctgtactaaaaaatacataatataggccgggcgcggtggcttacgcctgtaatcccagcactctgggaggccgaggcaggcagatcacgaggtcaggagattgaaaccatcctggctaacatggtgaaaccccgtctctactaaaaatacaaaaaattagccgggtgtggtggtgggcgcctgtagtcccagctactcgggaggctgaggcaggagaatggcgtgaacctgggaggcggagcttgcagtgagctgagatcgcaccactgcactctagcctgggcgacagagcgagactccatctcaaaaaacaaacaaacaaacaaacaaacaaacaaacaaaatatatatatatatataatatatataaattagccgggcatggtggcgcatgctggtaatcccagctactcaggaggctgaggcacaaggatcgcttgaacccgggaggcggaggttgcagtaggcagagatcatgctgctgtactccagcctgggtgacagagtgagaccccatctcaaacaataacaaaaaattactccagtactttgggaggccgaggcaggcggactgcctgagctcaggagtttgcaaccagcctgggcaacacagtgaaaccccatctctactaaaatacaaaaaaattagctgggcatgagggcatgcacctgcagtcccagctacttgggaggctgaggcaggagaattgcttgaacccgggaggcggaggttgcagtgacctgagatcgcgccattgcactccagcctaggggacaagagcgagacttcgtctcaaaaaaaaaaaaaaaaattacctatacactgcctcctcccacttttttgggagttttcaatctgagctttcaaaagattgattacatacaggaaagatttgaataaatcaataaatacattaagggtgaggggtcaggtttctatcagagaaaggagttaacaaatatggcaaggcaaaagagtagaacaaaccctgtggtattagaatagattagaataactggtgtgggcttttaatatataaagaaaaagatatatgcatgtttatgtgtatatatagacatatatatatttcctacccacgtcctggtagggcctgcagatgacactccagtagcaataagcacatgtagcacccagatgtggtttctaaatagcaacaaccactaaaggaactagtctcctcaggagacaagttgactccagaatggggatgatgttcatcaaagccttacaaagaactggcattattcccagacatcccattactgggtatatgcccgaaggattataaatcatgctgctataaagacacacacacacgtatgtttactgaggcactattcacaatagcaaagacttggaaccaacccaaatgcccaacaatgatagactggattaagaaaatgtggcacatatacaccatggaatactatgcagccataaaaaaggatgagttcatatcctttgtagggacatggatgaagctggaaaccatcattctcagcaaactatcacaaggacagaaaaccaaacactgcatgttctcactcagaggtgggaattgaacaatgagaacacttggacacaggaaggggaacatcacacaccagggcctgtcgtggggtggggggagcggggagggatagcattaagagatatacctaggccgggcgtggtggctcatgcctgtaatccaagcactttgggaggccgaggagggcggatcacaaggtcaggagatcgagaccatcctggctaacatggtgaaaccccatctctactaaaaatacaaaaaattagccaggcgtggccgggcgcagtggctcacgcttgtaatcccagcactttgggaagccgaggcgggcggatcacgaggtcaggagatcgagaccacggtgaaatgccgtctctactaaaaatacaaaaaattagccaggcgtggtggcgggtgcctgtagtcccagctactcggagaggctgaggcaggagaatggcgtgaacccaggaggcggagtttgcagtgagccgagattgcaccactgcactccagcctgggtgacagagcgagactccgtctcaaaaaaaaaaaaaaaacaaaattagccgggcatggtggcaggcgcctgtagtcccagctactcgggaggctgaggcaggagaatggcgtgaacccgggaggtggagcttgcagtgagctgagattgcgccagtgcactccagcctgggtgacaaagcaagactccatctcaaaaaaaaaagagatatacctaatgtaaatgatgagttaatgggtgcagcacaccatcatggcacatgtatacatatgtaacaaacctgcacgttgtgcacatgtaccctagaacttaaagtataaaaaaaaaagaagcttgactctgaaaaaaaaaaaaaaaaagaactggcattattcaacctgtctgacagttccttagaaggccctatttcaaggctgtcttagaactcacccagtgtgaaaaaaccttttccccaggagcaccggttgaaaacaaatagaggtaactgtttgacttcatggcttcctgaggcagtgattaacaggtggagaaaacaacaggctaaccaaaaaggtttaaaggaaaagctggggaataagatgtccacagaggcttagaaaagccccaatatattcctgggcatctaggaagccatgaacatacccaggtctgtgcatatacccaaagctgtgcacatgctcaggaaagacctaagaatgtctcttacttgtggttgaccttgaggttctgcatagcaggaagtgaaagttaaggcagagttatcgaatgcctggcagagtgttataggtacatcccaacgtgcacacagagccccaaagcaaaaactgggatactcactgcttccaggcagtgagaacagaattttaagaaatttaacagaaatttaaagaaatttgtttaatcattacctgaccactaagctatctaagcagagacttcagtagccacaaacaacaaagaatacagactacagaatcaattcagaaaagtcactaaacaaaaatacaacagcaaaccctgggaagggaaacaatctgatttccggagtggccacattatttaaaatgtccagttttcaacaacaaaaagttataaaacatgcaaagaaacaataaagtatggcccatacacagggggaaaaaatgcaatcaatagaaactgtctctaagaaaacccaggcagcagacaaagagatttttaactatttcaaatatgttcaaagatctaaatgaaaatatgtctaaagaactataagaaagtggccgggtgcggtggcttacacctgtaatcccagcactttgggaggccaaggcagggggatcacctgaggtcaggagtttgagaccatcctggccaacatggtgaaaccccatctctactaaaaatacaaaaattagccgggcgtggtggcaggcacctgtaatcccagctactcagaaggctgaggcgggagaatcgcttgaacccgggaggtggaggttgcagtgagccaagatggcaccaaagagaatatcaacagaaagagaagttatttttttaaagacaaaataaattctagaattgaaaagtccaacaactaaaatgaaaaactcattagagggactgaacagcagatttgaacaggcagaagaaaataatcagtggtcttgaagataggtcaatttagatcatccagtccaaggaacagaaagaaaaagcaataaagacaaattagtagcctcaaaatgaaaagcaaaaacaaaaaaagaaaaaaaagaacaaatttaacagcctcagactgtgggacaccatcaaacacaccaatatatgtataattagagtctcagaaggaaagaaaaggaccgaaaaatatttgaagaaataatggcagaaaacatcccaaacataatggaaaatggtaatttaggaatccaagaagctctactaactccaaataggataaacacaaagagagccacagacacatcatatgcaagctgccaagagacaaagattctttaaatgagcaagagaagaaactcatcatatacaaagtatcctcaagaacattaacagtggatttcttctcagaaactgtagcagccagaaggcagtgggataaaatagtcaaaacaaggaaagacaaagattttcaaacaagaattctatatccagcaaaactattattcaaaagtgaaggaaaaaatgaagatttcccagataaacaaaatggaaagaatttgtcagtagtagacttgccctgcaagaataaggcagaccttcaggttgaaatgaaaggaaactacagaataactcaaatctacatgaagaaataaagtagactggtaaaggtaactgtttaggtaaataaaaaatacagtacaaatggattttttgtttgtaattctttttctttttaatttaaaagacaactacaagaagaaataattataaatctacattggtagacatataatgcataaagatgtaatttagatgacaataacacaatgttcgggaaggaacagagctatatagaaagaaagtctttacatattactgaaatgaagttcgtattaatccaaacaagactgttatgaattaagatgttcattgtaatcccagggcagccactaagaaaacagctcataaaatatagtaaaagcttgtaacatgtacacaaattagctcaaaatggataaaagaccaaaatgtaggacctaaaatgatacaactttcaaaagaaaacttacgggaatggcttcatgacattggattttgcaatgatttcttggacatgatatcaaaaaagtaggcaataggccaggcatggtggctcacacctgtaaccccagcactctgggaggctgaggtgggcggatcacttgaggccaggagtttgagaccagcctggccaacatgggaaaaccccctctctattaaaaacataaaaattagccaggtgtgctggtgcatgactgtaatcccagctacttgggagggtgaggcaggagaattgcttgaacctgggaggcaggggctgcagtgagtctagattgtgccactgcactctagcctgggtgacagtgcaagaccctgtcaaaaaaaaaagagtgggcaataaaagaaaaaaaaataagttggacttcatgaaaatttaaaacttttgtgtatcaaagaatagtatcaacagactgaaacagcaacccataggataggaaaaatacatgcaaatcatatatctgatgagggattgatattcaaaatatatgaaaaacttgccagatgcagtggctcatgcctgtaatccttgcacttcgggaggccaaggcgggtggatcacctgaggtcaggagttcaagacccgcctggccaacatagcaaaaccccatctctactaaaaatacaaaatttaaggctgggcgtggtggctcacgcctgtaatcccaggattttgggaggccgaggcaggcggatcacctgaggttgggagtttgagaccatcctgaccaacatggggaaaccccatctctactaaaaatacaaaattagccaggtgtggtggtgcaggtctctaatcccagctacttgggaggctgaggcgggagaatcacttgaactcaggaggcagaggttgcggtgagccgagatcatgccattgcactccagcctgggcaacacgcgtgaaactctgtctcaaaaagaaaaaagacatgaagaagtgcccaatatcactagtcactagagaaatgtaaatcaataatacaatgagacaccatttcatactcattagaatggcaattgtcaaaaaacagaatataaggccacgtgtggtggttcacacctgtaatcctaacacttcgagaggctgaggcaggagtatcacttaaactcaggaatttgagaccagcctgggcaacatagcaagaactcctctctactaaaaatttaaaaactagctgggtgtgttggcacacacctgtagtcccagctactcgggaggctaagatgagaggattacttgagcccagaagtggaggctgcagtaagctgtcattgggccactgcactccagcctgcatgacacagcaagaccttgtctcaaaaacaaacaaacaaaaaccagaaaataacaagtgttggcaaggatgtggtgaaactggaacccttgtgcactgctagtgagaatgtaaaacagtgtatctgctgtggaaaacagtaggacaattcctcaacaaattaaacaggctggacatagtggctcacgcctgtagtcccagcactttgggagaccgagacaatggattgcttgagcccaggagttcaaggccagcctgggcaacataaggagaccccatctctacaaaaaagaaaaaaaaaagtagccaggcgtggtggcacatgcctgtggtcccagctactcaggaggctgaagtgggaggatcacttgagcccaggaggtcaaggctgcagtgagctatgattgagccactacacttcagcacgcatgacagagcgagaccctatctccaaaaaaaaaaaaagagaaaattctgacacatgctacaacatggatgaatcttgaggacattacgctaaatgaaataagccagtcacaaaaggtcaaatactgtatgattccacttatatgaggtacacaaagtagttaaactcacggagacagaaagtagaatggtggctgccaggggctggggagaaaagactatagagagttattaataggttcagagtttcagttttataaaatgaaaataattctgtggataagggtggtaaagatggcacaacaatgtaaatgcactcaataccacagaactgtacacttaaaaagtttcaaaggtggccaagcacagtggctcatgcctgtaatcccagcactttgggaggccaaggcgggcagatcacctgaggtcaggaattcaagatcagcctggctaaaatggtgaaaccccatttctactaaaaatacaaaaaattagctgaacgtagtggcacgtgcctgtaatcccagctactcaggaggctgaggcaggagaatcgcttgaacccgggaggcagaggttgcagtgagccaagatcacgccattgcactccagcttgcgcaacaagagcaaaactccgtctcagaaaaaaaaaaaaaagtttaaaaggtaaattttgttacatgtattttaccacaacttttttttaattttctaaagtacagggtggctttctgcaatttttactatttccaaagaaaagcagaaatgatcagcaatgcccaggacaactcataaaaaccataagcatgtccagttccactgatcaaatgtccaggctctctgctgtagtcattcaacaatagcagtgttttagtttcctcctccttcccaaaaccatcactggagaagggaaaatattggctgacaagacaaaaagaggaaaaaataaagcaagactaacaagaatgtttcaggaatacttctttttttttttcagacagagtttcactctttcacccaggctggactgcagtggcacaatctcagctcactgcaacctccgcctcctgggttgaagcaattctcgtgtctcagcctcacgagtagctgggattacaggcgcccaccaccaggcctggctaatttttgtatttttagtagagacagggtttcaccacgttggccaggctggtcttgaactcctggcctcaagtgatccacctacctcagcctcccaatgtgctgggattacaggtgtgagccacggcacctggccaggaatacctctctgtggttcagttttcttatctgtaaaatagaggaaataacacgccctcctttccaaagggatgttataaggattaggtaagtattttaaagtgcttagcacgtagtaagtgccctataaaatgatagttgtcaggccaggctcggtggctcatgcctgttatcccagcactttgggaggccgcaggaggcggatcatgaggtcaggagttcgagaccagtctggccaacatggtgaaactccatctctactaaaaatacaaaagttagccaggtgtggtggcaggcgcctgtaatcccagctacttgggaggctgaagcaggagaactgcttgaacccaggaggcagaggttgcagtgagccgagatcacaccgctgaactccaccctgggtgacagagcgagactccatctcaaaaaaaaaaaaaatacaaaaattagtcaggtgtggtgtggtgcatgcctgtcatcccagctactcgggaggctggcacaggagaattgcttgaacccgggagcagaagttgcagtgagcccgagatggcaccactgcactccagcttcggcgacagagcaagactctgcctcaaaaaaaaaaaaaaaaaaaacaaaaccctaaagggtggcaggggaaggattaaaaaaaaaaaaaaaaaaaaaaccactaaattcagaacattctaattgccatttccccagcagtcctcatttctgaatcaatttctggcctgaaatcaaacaatcacttcaccaggtgaatctttctggcagttacaggggctactctacaaataaatatttactgaacagcagtcgagggtacctcactctgctaggctggcaaggaatacaagaagtaaaactgtcgtccttgtaagacatatataaaaagatcaaaaacacaaatgtaaaataacaattcagaagttacctagacacaggaatagaccatgtctactatgaaaaacagtgtctttgacccagtttttgaagactcgctaaaactatacactctcccatccctccatgattaaaaactaagctctgtatcctaacgttttttctgctgccactttcttttctcctttaattgctagagaaaagagtatgctagaagggtcaggactaaatctcaagaggtgcagtagtttcacacacgggtgctaaagagtctggtagtctttccttacttcattcatttattcaacaagtaatcatttaacacctatgatgtgccagacaccatgctaggcaaagtgaaaacgacggagacagacatgactccaattctcacgcagctttcaatctaataatctatattccacttaactgtacagttaagaactgacttattacctatgaaagaaaccctgagaatctcagaatctaaagggactgcaggagataaatgtcctcgtttttcacatagggtcaatgaggcccaaaagtgacttgcttaaagtcactatgcatcagtgacagtcagggactagaacccaggcctcctgaaactccaatcagtgtcctacatgctcctctccctgaggggaagcaggtacatgggggagggaaggaaaagtaaaccccatcaaataaaggccagatgtcagtcttccccttctcgaaagatgggggagctaaggtcaaaacggggtaggaagaggtcggaagctgcctcagtttccccacggaaaagcggccactcagcctagctataacacaggcttccctcctgcgattccttccaattcctcccgccctgccttgtcgaactccaacccgggacccagagagctaccgtagaaaattactccttcactcacaaggactcgcaccagcaacgccatgttcctcaataaccatttccgggtgaagagtgagtttccggtgtccccttttctacgtcctccttttgccggcgaaagactggcaaggggggcgcaggcgcaaagaggtcgctacgcgcacgcgctgttgttttctcggctgtgcaccaggctgtcgtgcccgggcacgctctccctgctgtctcccccactacacgtaacagtggttcaaatccttcccccacgcctgtctccttgaccccagacctcggggcttctcatatccctctctttattccccacctaacccagcctcactcctcagcccctccttcccaaactccaccccaacacttttcaatggaggttgaaaagaacaggactttaggaaatcccaatctttagaaagagccagaagaccgggcgcggtggctcacgcctgtaatcccagcactttgggaggccgaggcgggcggatcacctgagatcaggagttcgagactagcctggccaacatggcaaaaccccgtccctaactaaaaatacaaagaaagtagccgggcatgttggtgtgtgcctgtaatcccagctactctgaaggcagaggttgcagtgagccgagatcgcgccactgcactccagcctgggcgacagagcaggactggactctgtctcaaaaaaaaaaaaaaaaaaaaaaaaaaaaaagccagagaaggaggctaagataaaagaatacgggggataccagactcctgaaagtcaaggcaagaaggcggtcatgtgccgatctgaagcctggtagaggaagaaacttttgggatttgtggttggttggttgtttaagggaaacatctttgcatattgataggaaaagattagtgaagagtatacagggccgtgcccggtggctcatgcctgtaatcccaacactttgggaggccgaggcaggtggattgcctgaggtcaggagttcaagaccagcctgaccaatatggtgaaaccccgtctctactgaaaatacgaaaaaaattagccgggcatggtggcgtgtgcctgtaatcccagctacttgggaggctgaggcagggaatcgcttgaacccgggaggcagaggttgcagtgagctgagactggggcactgaactccagcctgggtgacaaagcgagactccgtctcaaaaaaaaaaaaaaaaaaagagtatacaggagaatcaatcaaagaggcaaggagcttcttgaggaaagtggcagagaacggccttggtagaagactcctcttccattacatcccaagagaagagaagacaaagtactggtgctttgggggttgagggagcagaggggcaggatgttgaaggacttctttcatttcattcagtcaacaaagacctattgagtcttccctatgtgctgaacacaagacatactggcttcatggagttcttagactggtgggggaggcataggaacccagtgaaaaaaattaaaactggggagctactttggttaggttggtaaggcctctccaagaaagtgacatgtaagatgaaatctaaaggaagaagaggagctagtcatgggaaataacttcactcgactatttttttaattaaatttattgatttttattaattgacaaaaaatatatattgtgtacaacaggatgttttcttttttctttttttttttttttttgagacagagtttcactcttgtcgcccaggctggagtgcagtggctcaatctcggctcactgcaacctccacctcccaagtcaagcgattctcctgcctcagactcccaagtagctgggattacagatgcgcaccaccacgcctggctaatttttgtgttttcagtagagacggggttttgccatttcggctaggacggtctcaaactcctaacctcaggtgatccacccacatcggcctccgaaagtgctgggattacaagagtgagccaccgtgcccccggccaggatgttttaaaatatgtatacattgtgaaatggctaagtcaagctaattaatatatgcattacctcatatttttgtgctggaaatgtttaaaatatgttctttaagcaattttcaagaatacaatacatattcatagtgggtatagtcaccatgttatacaatagatcttttctttttttttttgagacggagtttcactcttgttgcccaggctggagcgcaatggcgtgatcttggctcactgcaacctctgcctcccgggttcaagtgattctcctgcctcagcctcctgagtagctgggattacaggcatgcgccaccacgcccagctaatattatattttagtagagacggggtttctccatgttggtcaggctggtctcgaactcccgacctcaggtgatccgcctgccttggcctcccaaagtggcctcctgaacttatctctcttaactgaaattttgtatcctttgacaaacatctcctcagcctctagtaaccaccattctactctctacttctgtgtgttcaacttatattccacatatgagagaaatcaagcagtgtttgtctttctgtgcctcatttatttctcttaacataacatcctcccagttcatccatgttgtcatagatatgagcatttccttcttttttttttccttgagacagagtcttgctcttgttgcccaggctggagtgcagtggcacaatcttggctcactgcaacctctccctcccgggttcaagcaattctcctgcctcagcctcccaagtagcctggactacaggcatgtgccaccacacccagctaatttttatttttagtagagatggggtttctccatgttggtcaggctggtcttgagctcccgacctcaggtgatctgcccaccttggcttcccaaagtgttgggattacaggtgtgagccaccgcacctggccagcatttccttcttcttttaggctgaatagcattccattatatatataaatcacttttttttttttttgagacagagtcttgctctgccgcccagggtggagtgcagtgacacaatcccagctcactgcagcctgtacctcctgggttcaagcaattcttgtgcctcagtctcccaagtagctgggactacaggcacgtgccaccatgtccggctaatttttgtatttttagtagagacagggtttcaccatgctggccaggctggtctcgaactcctggcctcaagtcatctgcccacctctgcctcccaaagtactgggattacaggcatgagtcactgtacctggtcataaaccacattttctttctttctttctttcttttttctttttttttttttttttttttgagacggagtctcactctgccaccaggctagagtgcagtgatgcaatctcagctcactgcaacctccccctcccaggttcaagcgattctcctgcctcagcctcctgagtagcagggattacaggcgtgcaccactacacccagctaatttttgtatttttagtagagacgggtttcaccatgttggtcaggatggtctcggtctcctgacctcatgatctgcccacctcggcctcccaaagtgctggaattacaggcgtgaacaaccacgcccagccaccacattttctttatttgttcatcactaatggacacttaggttaattccatacttggctgttgtgaataccactgcaatgaacatgttagtatagatgcctcttcaacatactgatttcatctcctttgaatatatatccaatagtgagactgctgtatcctatggtggttctgtttttaattgtttgaggaacctccatactgttttctataatgggtgtactaatttacattccaccaacagtgtgcaagggttccctttctccacgtccttaggaacaatgttatagtagccattcgaacaggtgcaaggtaatatctcattgtggctttagattgcatttccctgatgattaatgatgctgagcattttttcatatacttgttggccatttgtatgtcttcttttgagaaatgtctattcagatcttttgcccattttaaaatttgggtattaacccctcatcagatatatggtttttaaatgttttctcccattccatacgttgtctcttcactccgttgattgtttcctttgctgtgcaaaagtttcttagtttcatataacactatttctctattttcactctttttgcctgtacttttggggtcatattaaaaaaattattgcccagacccaggtcatgcagcttttcctctatattttcttcttctagtaattttagtttgaggtcttgtgtttaaggcttaaatctatttggaattgatttttatttgagacagggtcttgctctgtcacccaggctggagtgcagtggtgcaatcaaggctcactgtagcctcaaagtcctgggcttaagtgatcctccctcctcagcctcttgaatagctgggtccgtaggcatgtgccaccatgcctagctaatttttttatttttagtagagatggggtacgggggtctctctatgtttcccaggctggtctcaatcttctgggcttgagcaatcctctcatctcagcctctcaaagtgctaggattaaaggtgtgagccataacacccgaccttcgatttttgtatatggtatgaggtgagagtctaatttcattctgcatgtggatatctagttgtccctacaccatttattaaaaagactgccctttacccattgtgtgttctttgcaccgttgttgaaaatcaattgactgtaaatgcataggtttattttgggtctctattctgttctattggtctatgtgtctgtacaaatgctattctatcagcaaatgttgggaagtgggagagggacagaagatttcagaacaagagtcttgaggtggggaaaaaaaacagtacattttaaggccgggtgcagtggttcatgcctgtaatcccaacacttttgggaggccgaggcaggtggatcacctgagaccaggagttcgagaccagcctaggcaacatggctaaactctgtctctacaaaaaaatacaaaaaattagccgggtatggtcgggggtcgctctgtcgcccaggctcgagtgcagtggcgcaatctcagctcactgcaacctctgcctcccggattcaagtgattcttctgcctcagcctcccgaatagctgggactacagctgtgcatcaccatgcccggctaatttttgcatttttagtagagacaggatttcaccatattggccaggctgttcttgaactcctgacctcgtgatccgcccgccttggcctcccaaagtgctgggattacaggcgtgagccaccgcatctggccagaggaattatattttaagagacaggatctctctatgttgcccaacctgatcatgaactcctgggctcaagggatcctcctgcctcagcctcctgagtaaccgggactacatgtgagagccaccgtatgcagccattggaggatattaagtagggagggctacctaattcatatttaagaagttgactttgggccatgtacggtggctcacacctgtaatcccaacattttgggaggccaggctgggcagatctcttgagcccaagagtttgagaccagcctgggtaacatggcaaaaccctgcctctactgaaaacacagaaaaattagctgggtgtggtggtgtatgcctgtggtcccagctacgcagaaggctgagatgggaggatcacctgagcctggggaggtcaaggctgcagtgagcactgatcgtgccactgtaccccagcctgggtgacaaagtgagaccctgtctcaaaaaatatatacattaattaattaaaataaaaaatcaagaaacagtttttgttgtggtttgtttgtttgttttttgagatggagtcttgctctgtcacccaggctggagtccaatggcgcaatctcggctcactgcaacctccgcctcctgggttcaagcgattctccagcctcggcctcctgagtagctgggattacaggcgcccgccaccaagcccacctaatttttgtatttttagcagaggcggggtttcaccatattggtcaggctggtctcgaactcctgacctcaggtgatctgcccgcctctgcctcccaaagtgctgggattacaggggtgatccaccgtacctggtcaactcccagtcttaacacaaacagagcatataatgatggcagacaacattccagagagggctacaagggaagtaatattcaaatgggaaggccaggtttcattcatgcagaaagtagaaggaactttctaggaatgggctggcagtatagacaactttatctcacatagattccatagtcctctcacagaggactccccattctccttaacctcagctccccagtgctgctcggcttccctccgctgccagagctcctcaacttcttgtaccccaaaccctcagcctgaagccccagcaatctccactgttctccccaagctccctctgcccatctttctcttcacaatgacttcacccctcagaattcccatacttctttataggccccacattgaaacccagccgtttatttaaaataaaacaattgggccaagcatggtggctcatgcccataatcccagcaactcaggcagcccaggcaagaggattccttgaggccaggagtttgagaccagtctgggcaacatagtgagaccccatctctatgaagaaaaaaaaaatttttttttttttgagagagactcttgctctgtcgcccaggctggagcaatctcagctcactgcaaactcttggaaaacagtctggctgttctatgaattttaaacatacagttactatatgattcagccattccattcctaggtatatatccaagagaaatgaaaatatatatccacacaaaaacttgtttgcaaatgttcatcacagcattattcataatagccgaaaagtagaagcaacccaaatatccatcaaccaaagaatagataaaaacaatatggtggccaggcacagtggctcacgcctgtaatcccagctctttgggaggccgaggtgggggggatcactcgaggtcaggagttcgagaccagcctggccaacatggcgaaaccctgtctctactaaaaataccaaaaaaattagccgggcatggtggcaggcgcctgtaatcccagctacttgggaggctgaggcaagaaaactgcttgaacccgggaggtggaggttgcaatgagccgagatcgtgccattgcactccaatccagcctgggcaacaagagcaaaactaaaaaaatgaaaaaaccacaatatgctatatccagacaatggattattacgcagcaataaaaagaaatgaaatactaatacatgctacaacatgaatgaccctcaaaaaacattaaatgaaagaaaccagtcacaagaggccacatattggattgttccatttctataaagtgtgctgccccacccactcccatggccaattttagacctcaacaccagaattgtttgaattctgaaatttttaatttatgccttctgtgttctcaccatcctattattctggttttcattcattacccctagtacgcctgttgttctaccccattgagacaccacactttttatctcttctctttatagtctattgaccctctcccctctttgcttctcccatctagttcccatctggtctattgttttaatttctctcttgccagtattaactcccttgctcaattgtcttcctatctcgtccacctagaaagacctcaaccctccaattgtctatttattccatgcctgcctccggattcttgagtactatcgaagaaaatcatgcaaatattatattggtaccactaaatatggttttcaacctttattaagttatactctgtccaccttcttcaaaaccaccatttataactacattagattgttagggctgccataaaaaagtgccactatgtgggtggcttaaagcaatggaaatgtattgtttggtagttatggaggctggaagtctgaaatcaaggtgttgacagggccacgctctatctgtaggttccaggagaggaagcttccttgccttttctagcttctggagattgccaacaatccctggcatttcttaccttgcacctgcataactccaatctctgccactgttatcacatgacattctccctgggtgtctgtctctgtgtctcttctcttcctcttcttttttttttttttttttttttgagatggagtctcattgtgacacccaggctggagtgcaatggcgcgtctccactcactgcaacctccacctcccaggttcaagtgattctcctgcctcagcctcctgagtagctgggattaaaggcacccaccaccacgcctggctaatttttatatttttagtagagacggggtttcaccatgttgataaggctggtcttgaactcctgacctcatgatccacctgccttagcctcccaaagtgctgggattacaggcatgagccaccatgcccggccaatacgtatgaattctatctgctcctcgccaatctccactgcctccttcctaggtaagactaacgtcttctctcacctggactactacaactgacttgatcagcaagttatgttgatagagcatttcaggcagaaagaatagcacaattcaagaattggcttgaagattttgaggacaaaaggaaagccaagatcagtgtgactggaagataatgagtgagggttgcagtataaaagatgaggtctgaggcagggcgaggtggctcacgcctgtaatcccagcactttgggaggccgaggcgggtggatcacgagttcaggagatcgagaccatcctggctaacacagtgaaatcccatctctactaaaaacagaaaaaattagccgggcgtggtggtgggcgcctgtattcccagctactcgggaggctgaggcgggagaatggtgtgaacccgggaggcagagcttgcagtaagcgaagatcgtgccactgcactccagcctgggcaacagagcgagactccgtctcaaaaaaaaaaaaaaaaaaaaaaaagatgaggtctgagaggcaggcagagtccagattttgggggccttgaaggtccatgataaggagtttgcattttattttattttattttaagcaaagcagtgacatgttttaaaagggctctcttagctggtttacagagaatagattgtagatcatagcatagtttacttccagcatgctctttaggcttggcaagttgagatgttaatgcgaccccaattttggggcttgctctagcttgctttcactgtatatgaaactggaaagctatccaagttgttttcattttagcttcaaataaggaaacctcttttattctctgttaactgccaaggatcaagagtccctccctggaagaggtaaggtgatacattctttccctggagaaaaaactgttagaggaagccagaaagaagaagggaaggggggcagtgtcccaatcccattagattatgcaatcaagccgaaggtacccacctccattcaaataaagtgattgtgctttcctaaaacgaaaagccattgtctatcaagaatttatgctgatttacaaatttatctatgtgaaaatctttaggaaagttaaatatttaataaatcaccttttttttttttttgagatggagtctcactctgttgcccaggctgcagtgcaatggcgcgatctcggctcaccgcaacctctgcctccggggttcaagcaactctcctgcctcagcctcctgagtagttgggattacaggtgcctgccaccacccccggctaatttttgtatttttagtagagacaaggtttcaccacgttggccagactggtcttgatcagcaagttatgttgatagtgcatcctgacctcaggtgatccacccacctcggcctcccaaagtgctgggattacaagtgtgagccaccacgcccagccaatcaccttttttttttagagataaggtctccctctgtcacccatgctgagcacagtggcatgatcacaactcattgcagcctcaaactcccggctcaagtgatcctcccgcctcagcctcccaagtagctgggaccacgggcacataccactaggcccaggtaattatttttactttttgtagagatggggtcttgctctgttgcccaggctggtctcaaattcctggacatgagcgatcctcccacctgggcttctgaaaatgctgggattataggtgtgagccaccttgcccagccataaatcatggtttgttttttatttttttgagacagagtctcactccgtcacccaagctggagtgcagtggcatgatcccggctaactgcaacctccgcctttggtgttcaagagatcctcctgcctcagcttcctgagtagctggaattacaggtgcacactaccacacctggctaatttttgtatttttagtcgagacagggtttcaccatgttggccaggctggtctcaaactcctggcctcaagtgatccacctgactcggcctcccaaagtgttgggattacaggtgtgagccactgagcctggccaaatgacctttattaaaaagacaaattttatgctgaaactgttctagaactttcagaatatatatactctatgactacaggacaatatttgccaatgggatcagttatgatgtctgtttctctttgaggaacagtctatgccctttacctatcaattaacccagcagagggctggtttctgtgtcttattggcccccacacaaagttgttttctttgccccttagtgcagtgcagacaattctattaagaaaccattctattggccgggcgcggtgtttcatgcctgtaatcccagcactttgggaggctgaggctggcggtcacttgaggtcaggagtttgagaccagcctggctgatgtggtgaaacgctgtctctactaaaaatacaaaaattagccaggtgtggtgtcatgtgcctgtaatcccagctacttgggaggctaaggcatgagaatctcttgaacctgagagaagaaggttgcaatgagccaagatcacgccactgtactccagtctgggtgacagaacaagactctgtctcaaaaaaaaaaaaaaaaaaaaaaagaaaaagaaaaagaaacctttctatgaatcttattgttgtgtttattgtaataatgtaattgaagatatttgttacgttagttttcaagaatggctgtacaatttgctgagcaatgcttgattaactcagatgcaataacctgtgtaatagcctattttcttgctttgtattgattgctagacagcttaggtattgctcacctgtagcagatatagatcaatatgatccacattttagccccattcttggcttcattttgttcccttgttttcttttcctattgattcacatttgatttatcttgtcttgcattttacatatcttactaagactttaaaatcaattcttaaacatggcaaaataggaaggggtgaatgatattgaatatactgaaaccatttccaagcaggcattaaattctatccttttttgagacagagtctcactctgccgcccgggctggagtgcagtggcacgatctcagctcactgcagcctccactttccaggctcatgcctcagccccctgagtatctgggattacaggcctgtgccaccatgcccaactaatttttgttttcttagtagacacagggttttgccatgctggccaggtggtctcaaactcctggcctgaaatgatccatccgcctcaacctcccaaagtgctggacgggtagattgcttgagcttaggagttcaagaccagcctgggcaacatggcaagaccccgtctctacaaaaaagagataaataaattgttggccgtggtggtgcacagctgtggtcctggctactcaggaggctgagatgggaggattgcttgagcccaggaggcagaggttacggtgaaccaagattgcgctactgcactccagcctgggccacagagggagaccctgtctcaaaaaaaagtaaaaatatggccaggcacgttggcttacacttgtaatcccagcactttggaaggccaaggcagacggatcacctgaggtcaggagtttgagaccagcctggccaatgtggtgaaaccccgtctctactaaaaatacaaaaaaattagccaggcgtggtggcaggcgcctgcaatcccagctacttggaaggctgaggcaggagaatagcttgaacatgggaggcagaggtttcagggagccaagacggtgccattgcactccagcctgggcaacaagaacgaaactcaatctcgaaaaaataaaagaaaaagaaaaagaaaaaataatggaaattatttgtttgcattcctgtctctataactagactataaactcttttgaaggcagttattgttcattcattcaacaaatacaatggagtcacattatgtacccatttgacttacttgacttcttagggaaaacataaaaaaaagaagaaagaccaatactctatgattccacttatgtaaggtacctggagtagtcacgttcatagagacaaaaagtagaagggtggctgccaggggctgggaggaaagggaaatgggaagctgctcaaatgggtagagggtttcagttttgcaaaataaaaaagttccagagatctgttgcacagcaatgtgaatatagttaacagtataaagtatgcgcttcaaaatggctaagatggtgaattttgttatgtgtttattaccacaattttttaaaaaaagaaaaggaagaagaatcagctagcagtgcttgagatgagaacatgaatctgtgctgtttccacggctggtcttggttccttccttcatagagtatgcatctcactgggctgaatgtgattttattgtttaaagataaatgtttctggccaggtgcggtggctcacgcctgtaatcccagcactttgggaggctgaggcaggaggatcacctgaggtcaggagttcgagaccagcctgtccaacgtggtgaaaccctgtctctgctaaaaatacgaaaattagctgggcatgatggcgggcgcctgtaatctcagctacttaggaggctgaagcaagagaattgcttgaacctgggaggcagaggttgcagtgagcaaagatcacaccactgcactccgtcctgggcaacaagagcaaaactacaactcaaaaaaaaaaaaaaaaaggataaatgtttcttacaacatggcccctacatgcaaggcagctgcttacatgggccttaatcaaagaaactgttttcctattggaggggaaaaatggtcatactaaacttgttaagagaagagagagttaaaagaatcttcaaggatcatttttactatatgagtattaccatatagtaaaatatattatatatcaaaaatatattacgtatatcatggagttcctagtaccagtttttactactgttttctttcctcaccaactctcaagcgatatgtctaatctttgaggccctggctgttgggttttctctgttctccaagtcagcacctctcagaaggcaagtggacagcctcaagtgcccaaacctaagggacttggcagctcccagctgaagccatccttcacagagtcagtggaaccaatcatcaacatgatatgattttaaggatgggaagatatgtcctctgcaccttgcaaactcatgttattcgtttgctcatatagtccctatgctgaatatgtcttccttcaaccctgctatggcttgagtattttgagtgtgtcctccaaaagttcatgtgttggaaacttaatccccaataccatagcgttgggaggtgggccctaataagaacgcgattgggtcatgagggctgagtcactgggaattgattaatgttgtcatcacagaagcaggttagttattatgagtgggtttttgtttttttgttttgttttgttttgagatggagtctcactctgtcgcccaggctggagtgcagtggcatcatcttggcttactgcaacctctgcctcccgggttcaagcgattatcttgcctcagcctcctgagtagctgggattacaggtgcgcaccaccacgcccggctaatttttgtatttttagtagagaaagggtttctactaaactccatcagggctggtcttgaactcctgtcctcgtgatccgcccgccttggcctcccaaagtgctgagattacaggcgtaagccaccgcgcccagccaagagtgggttgttataaagcgaatccagccccggatgcctttctctgtttcacatgttcgcttccaccttctgccctttgcccatgggataaagcagcacaaggccctcactggataccagcaccacactctttaacttcccagcctccagaactgtgagctaaataaatgtctgttcatcacagattaaccattctgtagcattctgttacagcaacagaaaatcgatcaagacaaactccactcaagtttcattcagtcttcaggacccagctcagtcccttatcctccgtgaagccttcttaccattttctccattgttccactcacttgtcatgtgaacatttaattaccttctttctcttatttacctgagttaaactattatgtatttctcacataattctttatttctttctttacttttttttcttttttcagacacagggtctcactctgtcacctagcctggagtgctgtggcatgaccatggctcactgcagcctcaaactcctggctcaagtgatcctcctttctcagctgcccagatagctgggactacaggcgtgtaccaccaggcccagctatttcagagacagggtctcagtgtgttgcacaggctgtattctttttttcttttttgagacagagtctcactctgtcacccagactggagtgcagtggcatgatctcagctctctgcaacctctgcctcccgggttcaagcgatcctcatgcctcagcctcccacgtagctgggactacaggtgtgcaccaccacgcctggctaatttttgtgtttttagtagatatggggttttgccatattggccaggctggtctcgaactcctgacctcatgtgatccatccgccttggcctcccaaaatgctgggattacaggagtgagccacaactcccggcccaggctgtattcttttttttttttttttttttttgagacagactctcactctgttgcccaagctggagtgcagtggtgcgatctcggctcactgcaagctccgcctcccaggttcacgccattctcttgcctcaacctcctgagtagctgggactacacacgcctgccaccatgcccggctaattttttgtatttttagtagagacagggtttcactgtgttagccaggatggtctcaatctcctgaccttgtgatccgcccgcctcagcctcccaaagtgctggaattacaggcgttagccactgcgcccggctaggctatattctttacttcttttgttattatttaatatgtcatgtttgcaggccttgactcccccattatcaataaatacaggtaaagtttataggccagacattcttcaaaggactttttatgaacattatatataaccttcccaacagctccatgatataagaactattattgtctccatttgacatatgaggaaacttgaggaaagatagctgtggtgactttgcacaagttcacacagcaagaatgaggcatagctggagtttaatttcaggctgtctgacaccatagctcaaacctatgttcaatgtgcaggattggagggatctttagtgtttatctagtcaacttccctctcttgcactgctctttctcttcctctaaaccaagctcaaatcccttttccagtttcccaagtcgttatctaaactctttttttactttttgctttctatttttatttatttattttttttaagatggagtctcactctttcacccaggctggagtgcagtggcatgatctcggctcattgcaacctccacctctttggttcagcaattctcctgcctcagcctcccaagtagctgggattacaggtgtgcgccaccccatccagctaattttttttaatttttatcagaaacggggtttcatcatgttggccaggctagtctcgaactcctggcttcaagtgatccacctgccttggcctcccaaggtgctgggattacaggtgtgagccaccacacctggcctattttttatttttttgagacagggtctccctctgtttcccagcccaggctggagtgcagtggtgtgatctcagctcactacagtctcgacctctcaggctcaagcaatcctcccaccttagtctcctgagtagctgggactacagccacacaccaccatgcccagctaatttttaaatattttttagagacagagtctccctatatttcccaggttggtctcaaactcctgttctcaaggagtcctcccacctcagcctccctaagtgctgggattacagatgtgagccaccacacccacccctaagctcttcttgccatggagaacttagtattttgccttttccatctttagacttaaaaagctctcctttaaattcatctgacttctgcctaaggaggaatatagtatagtagctcatctgtacaatggagattatagtagctatctcccaggatggttgtaaggaatgaatgaagtcaggacaaaagcatttagctcagtgcctggcaccaggagctgctgaacacacagcagcaatgagctatcctttacttctctttacagatctgtgctttggagccacacaaaccaatcacttctcttttacccatggtagtccttcagtcttttttttttttttttttttaacatggagtcttgctctgtcacccaggctggagtgcagtggtgtgatctcagctcactgcaacctccgcctcctgggttcaagctattctcctgcctcagcttccggagtagctgggactaaggtgcatgccaccacgcccggctaatttttgtatttttagtagagacgggagtgttggccaggctggactcgaacttctgacctcatgatccgcctgcctcggcctcccaaagtgctgggattacagatgtgagccactacgcccggccagtccttcagtcttgaaagctgtgatcatttgctctaagttgtcatcactctgctcttcctcttcctccttttctttttttatctctatatctctagttccttcaactgaatctcacaaggcattgtttctaggccccttattattctgtcctcctctgcccctctcactgtggtcactgaacagagtgaaaccacaatttccttgggtttgtgctacgtgtctattaatgaagcccacaattgtattagcatttaggccgccgcattatattcagctagctccagccagctccattgagttcgtagccacctacagcaccatttcttccccatctgaaactgtgaaatcatgtttttttacattctatacctgtgcagttggtttcatgaattcagatggataatttgactgttttctctcttttattttatctcctctgattcagcctatcttatcctaacatcttttggaatctttatgtcttcttccatttatgcacagattttgaggacaggattgttgcaaggtaagagaattcctgtaaagcacaagtacgtggcatgcaataagtccttgataaacattaacaatggtgattgttattattatcctcagcacagcatctggcccatagttgactctcaataaatagtcactgattaatgaatgagtgactggatccatgattggtgaaatgaatgaatgttccctctcctgaatcctaggcccagtaaatttgatattatccttcttttacagataggaaaactgaggctcagagagcttaaggaacttccccaaagtagctcagctggagagtggtaaaaccaggactagaactcaggtctgcctgattcccaggcctgtgtgactaacacttccccactatactttcttacatctgtattcaggtcagaactagttgtggagtcagaagtctgaggggtttcccgagattgtatgttccatgccctagaaaagcgggttctcctgttgtgaccctgggagatgtggaggggccatgagatgggggacagagcactggaagcctcttctcttttctcccccatgggcctctcaattttcactgccttaaactctgcttagctgtttctcgcaagaaactaacagcgctgtgtgtccccaaggagaaacttttaagaccaaggagccaagacccagggaggtgattcaacagcttgccaggactgcagtcagtggagtcaagggcccagagagcagcagcaagaatggtataaagaacactgagggcccagcgcagtggctcatacctgtaatcccagcactttgggaaaccaaggtaggaggattgcttgaggccaggagttcaagagcagcctggcgaacatgatgaaaccccatctctactaaaaatacaaaaattagcctggcatggtggcactcgtctgtagtcccagctactcaggaggctgagacaggagaatctcttgaacccaggaggcagaggttgcagtgagtgagctgacattgtgccactgcactccagcctaggcgacagagggacactctgtctcaaaaaaaaaaaaaaaaagaagaacactgagggccaggtgcggtggctcatgcctgtaatccagcactttgggaggctaaggtaggaggatcgcttgaggctaggagttcaagaccagcctggataacacagtgagacctcatctcttaaaaaaaaaaaaagtttaaaagttagccagatgtggtggcacacacctgtggtcctggtacttgggaggctaaggtgaaagctgcagtgaggtgagctatgattgttccactgaattgcagcctgggcaacaaagcaagaaagaccctgtctttaaaaaaaaaaaaaagaagaagaagaagaatgcagacctgcaggaagctgtagttatcactctgcctctttggatatcagcttccgcatctgtaaaaagtgagggtggagagttcttgccttacctgcttcactacgcaaggcatggcaatgataacagctaacacatcctgagtgccacctctgtgcctgctcctgtgttgagtgcttctcatatccttgcagttagcaccatgaaataagcatattgttaaccctctttttttttttttttttttacaaatgaggaaaccaaggttcatggaattaagttacttgcccaaggcctctaactctaagtgacagaactgaaattttgaaagtgtgcagccttcagagctgagtgaccatgggtggagagtgtttgtgaactctcaagtatgatagatgccttgtaccctttggggcaagaatgaacagtaccagtttgcagcttgttatggttgcggttggaggtgggtggctgggggagagtgttttccaaggaggcagctgaacagatcctgtggttaggatgggtgacctgatcacatccccagagtctgggtgggaaaatgcaggagggtccacagtctgaaagagagccctagggcaggttgtggtggtagaggaaactcctagcgtgtcaatccaaacagtccactgggagcccaggccttcagtaggaggggcattgtggctcagatgacatgaacctctctgactgggctaaggcagagagaagctccagttcggtcagaactttccaagaaaccagggacacgcagcccaggaaataatacctgtgggagtcagccccacctgtgacccattcatcttatctatctgcccttgggtttctggccccccagtttctacactgctctccctggatccccagcccactccttggcttccccagcacctcccttccaggcccattctcccctcacacacaccacagctctgtctgccacggcagctcctttgtttacttccagagctgccaggcccaccactagccaaacacaacgaagcccagccagtgaggggaggctccaggctcagtctgtcccctcagagagaggtaatagcctccagaccaaggaggcagctcaaaggtaggctgcccccgcactgtgcccaagcttcaggcctagagggaaagggcacaaggtctgcccatagctgggtaggaatccctactgttgaagcagctttggtgaggagccccaggaatcaaagacccagctggagggaggtaggggaaatgttgaagccccctgggtgggaagtggaggcttagactgctcctggttctccctgtgtctattctgccaggtagaactggagtcctcagcccaaggcacccatatgcctgtctccccaccagagggctatgttcccctcccaaaagtctgtgccctgtgcctccccaaagattccagctgagaaaaggaagtgagcatttactctgggccaagccccaagcaggaaacattgtcagggtgtgcctggcatttgtctgtctgaggttagtggggagtttatttatctgatgtataattatgtatttatataatgtgtaatataaaggcaggggactccgattctgtttctggagctgggggctgatgggtgagcagtgaggtgtagtgagggtgtcaagctggagggcaacagggccacagacatggtcatgtgaggaacagtggtcagtggcgagaggagatgccccaacagggagaaggagagccttggcagcccagattccccaggggagagataaaggactctttcaatggtgcccaggtaattctgtgagtatgggggtagcagggcaggcagatattggtcgatgatgtaggaatgattttagaagaaatgaaatccccaatttccctcccttttagggatctattttggagacaacaaacttgactaaggaatctcaagaagaaaatataattctgctgccaggccccaatggagcaaatagagctcgggacccaggggcctttggaaggaacaggaatgcggttagaggtgagcactggccctgcttagctgcactctctgtcccattgtgcttcagtttccaggagtgggggtggggatagggctctgaaaactgagtttatacatgaagcaacccacctccctgccctgggtcagtaattcttcaaggggtcactgggtcccctggagtaaacaagaaatttgccacagttttaggcacagttttgctttttatctcatcaatatacatttaaatctaacagtctaacagcctcacactcctcaactctatccaagccctctcctcttctctcccactcttgcccagtcagcttctcaactgtcccagggacaggaagtcaccaggcacaaatgtgatttgaggaggcagtggcacctgtggctctcctgagaggtgcttaggagagtccagaggctgagaaggcccaggtgaggagaaatggtgggctgagtctcatcggaaagcactgtttcctgggactcagtcccattcagagtctgtctccctggacctgtgcctgccactggtcacatcagcagacgggcagcaatcctcagccaggggaacttgtggataaaagggggcctttagcccaagtcacactcagagagcgagcaagcttattggaatcccctttcacccaagctgtgtagatgctcctgccacagcttcctgacccctctgtgattccaggagtgcaggaaggggctcttgggatgtgccacccaggaagacagagggccagtgctgctacctgcagccacacgactccacgaccatgtcctcatactgcttatacaccacgttgttggcagagtcaatgaagaggatgctgatgggactcagccgcgtgggcacacagcaggtgggtggtgtggactcggggtccatggagttcatcagggtctggatgactgcatgattcgtgggctccaggtgggagcgcaatgggaactcgcacagcccctcgcagtggaaagcctcgtactcaaggggtgcgatgatccagtcgtcccagcccatgtccttgaagttgacatgcagtgccttccgactgcagcgagccttaaggttcttgctgggtcgcttgccctggcgagtggccagtggggcccgccgttttcgccgctggctgaacaggtactcatacacggtcttatcgtcctggccagagcgggccttaatctcattaaagaacaggtcccgtttcttggtgcggccaaacaccaggaacagggccttctcgtggacctgccgggcggcgcggtcgaagcccaggccacggaggtccacggccctgccccgttcccaggcctccagctccaggcacagctgggccgagttcttaaagtttcggaagagcttccagatgtcgaacacctcccagccagatccgtccaggcctggcacggagcgcacatccagcaaggaggccggctgccggccgctggggcagctggacagcttcagctgggcagcccgcccgcctccgggggccgctggcttggccgtgtccgagggcttcttccgcaagatccgcagctcggcccccagcagcccatccttctccagggcactaatgtcaaacacgtacctctgcttcctgaccacgggacctcggtcatctagagagaacacccagaagtcattccctgcaacctcaccaagggagccagtcacttcgaggctgcgggggaaggccccagctctctccccgtccagagagctttctttcacctctgccccattctgacagaagccaagagccaaaccactgagagcctttttgaaaatgagagcatttcctacatagccgaccaagtaggggtgttcacctgaagatgtggctggggatgatttgcgtgattctggtgtttgtgtcatgatatacgtgttatcagagatttatcagctttgtaactgccttctacctatctctctcccagccatgagctaacgtgatgtctcatttgtgagataggtggagtgagcattaaaattactcctgttgactgggcacagtggctcacacctgcaatcccagcactttgggaggctgaggtgggtggattgcttgagctccggagttcgaaaccagcctgcacaacatggtgacactctgtctctacaaaaaatacaaaaattaaccaggcatggtggcgtgcacatgtagtcccagctactcaggaggctgaggtgggaggattgattgaccccagggaggtcaaggcttcagtgagccgtgaattcgctattgcactccggcctgggcaacagagaaagaccctggctaaaaaaaaaaaaaaaaaaaaaaaaaaaaaatacacgcttttccagaggagaatcccaaggttcagagaagttagatgacttgctcaaattctcagctgcttccaccatcccttaaaggagaccttggtgctcttgttatgcagatgaggcacagagatggggagtgacttgactaaggtcacacagcaagttaatgacaaagctggtccacactgacctacagcccaattttcctggctttccagtgcaaggattttgttgcctatgtgtcttactctcctgagcatgtgtgtgtgttacagttgtatgcatgtgtgtgattgggttcatatgtgaatatgaaagagtgtatacgttaatgacgcattatatgtataaatgattgggcttgtgtgactatttgaagagcacatatatgtctgtatatgcatgattgatcttgtgtgtgtatgtaagaaggtgtgtgtgcacatgcatatgtgtgtgattcggcatgtgtgtacgtgtgtgattcagcacgtgtgtgtgtgagtcagcatgcatgtacatgtgtgattcagcatgtgtgtataaacataaggctatgtatgtgtatgtgagaagctcagtagtatctccgaatcagcatgccctccttcctaaattgcaatttgccattggggagctttcatatattgctctagaaggtgactaattaggcctttaaactccccgtctccccctctccaagctcccttagtgctggggggcacacggacttattttatgagcccccaaggggtcacagctttccctggctgggcaggcagccagaccacctcccccacctcagccagacctgctgcctctgtgcctcccccgccccctggcagccccctccaggccagctctaatgaggagcctctcccaccctctgacccctcccccaccctgccagcctaggaccagagcaaatgagctgcaggcaacttgagcgaccaacagcccacctccctcttcacactaggaagaaactgaggccctgagagggggagggacttgcttagatcacacagcaagtggagaggaaaagctgcaacagtaacattaggtgggccgagagagacagaggggagcaggtagtctctggagttaatgaggagaatgaggcatgttcaggacagcatctaaagttttcatgttggaagggctctcagaaaccaccctgtccaaccccatataggtgtacagatgggaaaacggagaccccaagtgagaaggagctttcccaaggtcatactgcgagttaggccctgggtctgctccctccccatgtatctgaacatcattccatgactccaagatgccccatttactgtgtgcacctctcttgcctcctctatccccttgcctgagggcaaagttgcagaagcatggggacctcaagattcatttctttctctgccgtctgagaccgcctacaaacctgtggagcttggaaagttcggccagcccagcaggtacagatgcacaactgagcaatcaagtctcggaatctggtctccaactctgccacgaactggcaggtcttgtctcttctctaggctttagtgcccactctgcaccttgcaggcgttggacctggtgcttcctaggtgccctccagccctgatgtgtgggcagcctaggatctgctatgtgtgagatatgtgtcagtgtccccagacacccaccccgggccagatgcacacagtgtctcccaccagggcagtgccagggctttgaaagcccctccattcatgcagatgcccctccctctgagccgtgcccctgccaccccgccccctcaccttgccctttgtcaataaagctggtgatggtgttggccaggccagcctccaacttcacgctgctgttgcctccctttctgtcagcatcggacagcgtcctgtacagcgagagcatgtactcgtggggtgtgatggggggtgggcgaaacggctccttgggctctcgtgggggcccgggctccctggccttcttcagcaggaaggagctggggacagatcctgcttttgggggtgccttgcctccgggaagctgtccttttggggtcacagtccgggctgtagcctgccttgtttggggagggtgtcctggcttgggttcagggccgcccggtctggggggcagctttttgggttcatccttcttgggctgtgtcaggcctcctgtctgcccggtgcctccctttgccctggcattggcattggtggcccccccaccatagctgtgaccccctggcctgaagacgttccgggccagggggggcctctccttggcctctgctttggccaatcctggcctggtcccctggggtctctggcccaagtcaggggcacccaacacagtgcagatgaattccaggtccagccaagccaggtaccaaagcaagaaagtgaggagtttggggagtctcatcctctggccagccgctgaatgacaccaaagagaacagcggcagcagcaaaggtgcctctggtttggcaggaaaaaccatgaaaggagtggactttcaaaagcagcggcagcagcagtagcagcagaaggaaaggctttctcctcagtctgagactcttgaagtctgccgggtgtgtgtttgtatccagtcccatagtggaaatgctctcgtatccagacgtgcaccgtctccagtcagcagctgaaaataactcgttcttgaaaggagaaagccaaccgccccctttctcctgcacaactgactgagggcttgaaggaggcttgtataaggctgagggatttttccaagaaggaagaatggcgtaatgctgcctgtgtgctccagtttttttttccccctagttttgaatcctttccagtgaaaatacttcacacacacacacacacacacacacacacacacacacacacacactcacaggcctgcaggtgctcagaaaaatcttttacaaacctgaactcaggaattggaaacggaattccaacccaaaccaatttaattactctctgatgtcatgctgtctaaactcatttaagtgcgatatatttatgtgaaaaaaatcaccgctgccctttcgaggccatggctcacgggggctcctggcacagagccctgcagcgggactctaggcttagggggcctccccctccacggggcagactcaggggtcttcacctccacctcatggagcagcccaccccactttcccgaggagagatgctgaagaatgagctcaaagatcttaagccccagaagcatggggagtgtgggtttgtagttaagttcttagagtgtttttaaagcagtttcaactcctgcatctagtctgggacctgatttgttatgcgtgtgtgtgtgtgtgtgtgtgtgtgtgtgtgtgtgtgtgtgtgtgtgtttatgtgtgcctgtgtgtgtgtgtgcctgtgtgtgtgtgtgcctgtgtgtgtgtattgggagtagggacagcacagatggcagcatttacccacattttcttttattttaataaacttgtggtgacccagagactgaaaaatatcagtgcccactacaccccctccctacccccaaatgccattgactgagtgcatattcttcaggcttgggggcactgtcgcccttaagttcactccttggatggcggcaggtccagggtgtaccccaccaccaccccagcagagacgtcctctgagttttcttagacaagactggctgagtctggggcagcagcggcccctacaggaggctggaaaagccatttcccacatgacgctttttttttttttttttttgagacggagtctcgctctgttgagtgcagtggcatgatctcagctcactgcaatctctgcctcccaggttcacgccattcccctgcctcagcctccccagtagctgggactacaggcccctgccaccacacctggctgattttttacgtttgtagtagagatggggtttcaccatgttagccaggatggtctcgatctcctgacctcgtgatccgcccgcctcggcctcccaaagtgctgggattacaggcgtgagccaccgcgccgggcacaatttcccacatgatgtttttctggtagctctggaaggtctgaattccagctgaactcaagggtttcttaaagtgcctcattgaagtatggaagatcccttcctctggggaaccttcgccgtagagcccctgggcaacttaacacagggtcagcggggaaagctgttcgcttcacctgaaatatcctcctctctctctcccacaactggaggaagcactctacatcctgagaagtttagctgaaaatttacctccttcgggaagcctttcctcgtccccagacagagccagttaccccttctgtacatttctctacaacaacacttttcacgctgtaagaaggatggcgggggagaagcaatagtcagataggcttccttctttttttttttttttttttttttttttgagacagagtctcactctgtcacctaggctggagtgcagtggtgcgatcttggctcactgtaatctccacctcctgggttcaaacgattctcctgcctcagcctctcgagtagctgggactacaggtgcacaccaccatgcctatctattttttgtatttttagtagagacggagtttcaccatgttggccagtctggtctcgagctcctgacctcaagtgatccacccaccttggcctctcaaagtgctgggattgcaggcatctctaccaaaaatacaaaaaattagccgggtgtggaggcaaaggttgcagtgagccgagatcgcaccactgcactccagcctaggtgacagagctagagtccatcacacacacacaaaataagtaaataaataatattaataaaataaaaaaattaaaaacagacttgttcccactgaaccagtcctctctggcatccctcccttcactccctcctcaccacctctgtcactgccctgtcctcctcattgcttgcctcgctatgattctcccctataactggcttctaggcctccaggctctctctggttcaaccctctactaaaagctacccatcaaacaagtgccaacccacgtgccacctcctccatgaagccttcttgcatcctccagaaaatgcacactccccctgagctgccatcacacattttctgtgctcttttacattttttggcagctgaaagtttattcagtctctgcctctgccccctatcccaacacagtttgtttcttccactctgtattttgtcatattttaaaatcataacttaattccttataactataataatttctttacatacctgtctctcccattagattatgactagactgtgccatatttatctttgaattatacccagtgcttggcagagggcccagcccacagcagctctcagtacgtgttatatgaataaattaatctctaactggcccttattgacaaaaatcatcattttctactttgaggtgtagttatttgtggacataacctgcctttcccattagactctaagtttcttgaagggaagaattgtcttgccacttcttaagcattttgtaagctcagagagtgaataaatgaatgagttgaacaaccacaatgtctctgtacgtggcttgataaagagcaaggattctggagacaaacagacctggttttgaagcttggttctgctatttatgtattgtgtgatcttgggaagcctctaaacccctctgaaactctaaacagtgataacgatagtgcttacctcacaggactcttgttggagattcaatgaagtaaattgcggccaggcgcagtggctcacgcctgtaatcccagcactttgggaggccgaggcaggtggatcacgaggtcaggagatcaagaccatcctggctaacatggtgaaaccctgtctctactaaaaaaataaataaaattaaattgcataaagtgatcaactattaatggcaattgttaatgatagctttttttttttttttttttagatggagtctcactctgtcacccaggctggagtacagtggcatgatcttggctcactgcaacctccaccccccgggttcaagtgattctcctgcctcagcctcccaagtagctgggactacaggtgcgtgccaccacgcccggctaatttttgtatttttagtagagatggggtttcactgtggtagccaggatggtctcgatctcctgaccttgtgatctgcctgcctcggcctcccaaagtcctgggattacaggtgtaagccaccatacccggccaataatagctattttttttaaagcacttattccagtcaactagactctgggttttgtactccattgcatttatgtgttatttatcttcatgacaatgctatgaaggtagtggttttcattgttgttttttgagacagggtcttacctgttgcccaggttggagtgcaatggcgtgatcatggggctcaggtgatcctcccacctcagcctcccaagtagctaggactacaggtgcacatcacgatgcccagctaatttttgtattctttgtagagacagggtctcaccatgttgcccaggctggtctcaaatttctgggctcaagtgatctgcccgccttggcttcccaaagtgctgagattacaggtgtgaatcaccacatgtggccgaaagtaactttttttatttttttgagatggagcctcgctctctcacccagtctggagtgcagtggcgcaatctcagctcactgcaacccccgcctcctgggttcaaggggttttcctgcttcagcctcctgagtagctgggattacagatgtgtaccaccacgcccagctaatttttgtatttttagtagagatggggtttcaccatgttggccaggctggtcccaactcctgacctcaggtgatccacaaaaaagcattttgtaagctcagagagtgaataaatgaacgagttgaacaaccacaatgtctctgtatgtggcttggcctcccctagtgctgggattacaggcatcagccgccgtgcccagcccgaaggtaactcttgatacccgtcttttttttttttttttttttgagacagagtcttgctctgtcacttaggctagagtgaagagtgcagtggctcaatctcagctcattacaacctctgcctcccagtttaagtgattctcctgcctcagcctcccaagtagctgggactaccgatgcgcaccaagacgcccggctaattttttgtatttttgtggagacgggggtttcaccatgttggccaggctggtctcgaactcctgacctcaagtgatctgcccacctcggcctcccaaagtgctaggattacaggcatgagccaccatgcctggcccaatactctcattttaaagataaataaatttaggttcagaaaggttaaattattttttaaatctaattttggcttcaacacattttatacccaaaaagcctaatctggcccctagaaacactagaagtgatagggcactggggaaagttacagtattcctttcagtcaacgtctaacccagtgggctgggactttggggacatggaggagtctcgaggccagggctattgtttgaggaacagggaactcccagaaatgggctgggagcagggaaaggggactctgagcttggttagaaggccctctccagagaggagcccagggttcctgcctggctctcactataaaggtgactaatcactttggttccctctggtaattgcaaccagatgctgccgctggcagtgcttcagtcccgacatgtttaattactgggacacagcgtccctgggtcccccgtgtcccccaacctccccctctcctgtcagcaatattaatgtcaaacttgaggtagaggatgggagccttgggaagccactgacatggaagtaatctctgcagccccttctgccatgtagagccttttgcttttatgtttccccatccattgtctcattgctgttccataaaccatccttataaagtcagttggccagattattattattattattattatttttggagacagagtctagttctgttgcccaggctggagtgcaatggcatgatatcggctcactgcaacctctgcctcccaggttcgagcgattctcctgtctcagcctcccaagtagctgggactacaggcatgcgccaccacccctggctaatttttgtatttttagtagagacagggtttcaccatgctggccaggctggtctcgaactcctgacctcaaatgatccacccacctcagcctcccaaagtgctgggattacaggcgtgagccactgcgccggccggccagattattattatcccttttttattgtgtctccagatgagtaaacagtgaactgagtgataataataataatccctttttcaagcacttgtcaattttcaaaatggcttcccattcatgatgctatccgaacctcccgagatctctccgggagtcagtcctgcacagcacagcagctgagagaacaggcgctgggaccagacaatgcagtgttccagttctgccatttgccaattgggtgatgttgggtattcatttctttatctacttaactattcagcaaacatttattgggtgcctaccatgggatgggccccaggtagagttctgggtatctagccatggacaagacaaaccaagtgttttatctgaaatttctcttatgcgtttgtttgtctcttctcacattctggtggaagagacagaggaacaaacacgtaagagaatgctaagtgctgtgaagaaaaattaagcagggtcaaagaggtgtctattttagcaaggaatgccctttgagggggtgatgtttgggcagagacccagatgtagtgagaaaacgagacatactgaagtctggaggacaagcattccaggtggagggaacagcagttgcaaaggccctgaggcctttgcacttggtacatctgaggtaaggaggagctggtgtggctgaagcagagtgagcgaagggggcagtggcaggaggtgaggtcagatcatgccagaaccacatcttgtatggccttataagccctggaaagggagctggattttcttttctttttcttttgtttttttgagacaagagtcttgctctgttgcccatgctggagtgcaatggtgtgatctcagcttactgcaacttccgccttctggtttcaagcgattctcttgcctcagcctcccaagtagctgggattacaggtgcccgtcaccatgcccagctaatttttgtatttttagtagagacaggttttcaccatgttggccaggctggtctcgaactcctgacctcctgatctgcccacctaggcctcccaaagtgctgggattacaggcatgggccaccgcaccccgtctaatttttgtatttttagtagggatggggtttcaccatattggtcaggctgggctggtctcaaactcctgacttcaggtgatccacccgcctcagcctcccaaagcgctgggattacaggtgtgagccaccgtgcctggcctggattttacttttagtgcactgggaacccaatgggatgttttaagcaggagagtagtgaaataatgattaagagctaagtcactcaccttcaaatcctggttccccccatttatcagctatgtaatctcaagcaaattatttcatctctccctgcctcagtttcctcatgtataaaatgggaataataacgatatacctagctgggcaaaccggtaaaaacatacttggctcacacctataatctcagcactttgggagtctgagatgggaggattgcttgagcccagtagttcgagaccagcctgggcaacatagcaagacctgtctctataaaaataaaaaaaactggccgggtgcagtggctcacgcctgtaatcctagcactttgggaggcagaggcggggcagataacaaattcagaagttcgagaccagcctggccaacatggtgaaactctgactctactaaaaatacaaaaattagctgggcatggtggcgggcacctgtaatcctagctactcgggaggctgaggcaggaaaatcatttgaacccaggaagcggaggttgcagtgagctgagatagcaccattgcactccagtctgggcgacggggtgagactccatctcaaaaaacaaaaaaataaaaaaataggctgggcatggtggctcatgcctgtaatcccagcactttgggaggctgaggcgggcagatcacctgaggttgtgagttcgagaccagcctgaccaacatggagaaacccccatctctactaaaaatacaaaattagctgggtgtggtggtgcatgcctgtaatcccactattcgggaggctgaggcaggagaattgcttgaacccgggaggcggaggttgcagtgagctgagatcgcgccattgcactccagcgtgggcaacaagagcaaaactctgtctcaaaaaataataataaaaataaataaataaaaataaaacaataaaataaaataaataagccaggtgtggtggctcacacctgtaatcccagcacttcgggaggctgaggtgggcagattacctgaggtcaggagtttgagaccagcctggccaacatggtgaaaccccgtctctactaaaaatacaaaaaaaatagctgaatgtggtggcaggcacctgtaattccagctatttgggagtctgaggaaggagaattgcttgaacccaggaggcagaggttgcagtgagctgagatccagccattgcactccagcctgggcaacaagagcgaaactccgtctcaaaaacaacaacaaaaaaaaacttgtatcacagagtggttataagaattaatgtgtttatatatgtaaagtacctttcaatgaccaaaatacagtatgtgcttcataaattataattttatttattgctttttttttttttttttgagacagggtctcactctgtcatccaggcaggagtgcagtggtgagatctcggctcactgcagcctcgaactcctgagctcaagtgatcctcccttctcagcctcctgagtagttgggactacaggtgcaagccactgcacctggctaatcataaattacagttttgttttgttttgtttttttaaaaaagatcccactgttaatattgtccttgtttcataaatgaggaaattaagcctctgagtagttaagtgatcggcacaagttcacacagctaaagacgaccgagctagaattcaacccaagaccctaattctgaatccagtgcccttcccacgtaaagagaggactgaccaccctacaggttaggagctggcagggaggaaagcccagagtcccttcccttttcatctgtgctccttctaatctgtggggactgcctgtcccaacccctgagaatcccagcaagagcagagccgcctctgcctacactcacccgcgccgcaaacctggtttcttttcttttcttttttattattattatactttaagttctagggtacatgtgcacagcatgcaggtttgttacatatgttttttttaaatttttttattatactttaagttctagggtacatgtgcacaatgtgaaggtttgttacatatgtatacgtgtgccacgttggtatgctgcacccattaactcgtcatttacattaggtatatctcctaatgctaccccttccccctccccccacctcacaacaggccccggtgtgtgatgttccccttcctgtgtccaagtgttcttattgttcaattcccgcgtgttctcactcataggtgggaatttaacaatgaaaacctggtttcttttctaaactccgcagcagtggccactgctcaggacgcgctctcaagggctccccctgctgggatactcgggagctgcaccttgctagagttgagtgtctctgggccttctgtccataagtcaatcaaattccttccctgggctgcaaatacctgtactacaatctgaagctggaaattgtatgtgagtgttgcgtgtgtctgtctgttgtgggtagaggggtgtgaataaaataaccacatgttttacatatttattctagaaaatatttttatttttaaaataattctaaaacttataaaaagtcatacatattaggaagaaaagtaatatgaattcatgattttaaaaattcaaacagtagaaaagaatgcaaaagaaaatattttcctcccaccccagaccctgggtctttcagtcctccccagaagcaacaactctgatcagtctcctagatgactttccacacaatatagtaacatcagctttttaaaaactttattaggcagggcacggtggctcatgcctgtaatcccagcactttgggaggctgaggcgggaaaactgcctgagcccaggagttggagatcagtctgagcaacatggcacaagcccgtctctataaaataaaaaaaaaaatttaaacacctttttatcgatgcatgatattcataccaaatatatttgattataaaattaaatcatgttcattgtaaaaatattcaaataataccaaagtttataaagttaaaagagaaagttcccctctcccctcacaccccaatctctctaatcacaggaaacctctctaatcactggaaaccttgttgtcattcttgagctcagaaatctcagatccttgctggactcctccactcctccttccctccatctaattctaattcccactttgtgtataagaaccctagctggtaagtactgttatccccatattgcagctgaggaatttgaggctcagaaagggaaagagggttgctcaagaacataaggcaagctggacgcggtggtgcacatctgtagtcctggctacgggactttttgtttttttcaaaaaaaaaaaaaaatatatatatatatatatagttaagggcccccccgacttttttttttttttttttttttgtctcactctgtcacccaggctggagtgcagtggagcaatcttggctcactgtaacctcctcctcacaggttcaagcgattcttgtgcctcagccttccgagcagctgggatcacaggtgcacgacaccaggcccggctaatttgtgtatttttagtagagacagggtttcgccatgttggccaggctggtctcaaacttctggcttcaagcgatccacttgcctccacctcccaaagtgctgggattacaggcatgagccatcaggcctgaccaagggcccatttttgaggaaggagaggacctggtcctgtgggaactgtgactggacatcctttattgcccaagccctgagtgatagtgaaaagatgtcatccacttcaagaatctcaagcttgggtacgctggtcacttcgagactgacttagtgagtgagagggggctaggactggaataagaactgcctactgaggcggggtcaggaccagggagaaaatatccagctgacaaagggaatccaactagggagattgacacaattcaaccagatggtggcatcagcaagaggagtgtccggcattcctgacacatcccatgctctagcatgctgctgtgcctttgcacatgctgcttggaatccccgccaccaccccacccctgccactttgcttagcatttttttttgagatggggtcttgctatgctgcccaggctggtctcaaactcctaagctcaagaggttcttctgactcagcctcttgagtgggtgggactacagccacatgccaccatgcctggcttgtctgcttagcatttttttttttgagacagggtcttgctgtgttgcccaggttggagtgcagtggcttgaacacagctcactgcagcctcaacctcctgggctcaagcaatccttcctacctcagcctccagaatagttgggactacagtagtgcaccaccacacctggctaattttagcgtttttatccttcacaaacaagtcatagtggcctgatgctgtgtagccagctgctccctctttatagaatttactacactgtgtgtgtgtgaactatttctttacttgcttgcctgccatgtgagtttgtgaacagaggctctggacagagttcatttattattgttctttgggtccctcccagtgtataactcaacttttggcacacagtaggtgctcaatcaatattttaaaaataatgaatgaatggaacttcagcgcagcagctcaagcctataatcccagcactttgggaggctaaagtaggaacattgcttgatgccaggaattcaagaccaacctggacaacacagtgagtccccatctctacaaaaaaatttttaaacaaattagccaggactggtggcacaggcctatagtcttagctactcgggaggctgagccaggaggatcgcttgagcccaggagattgaagctgcagtgagctatgatcaaatcactgcactccaacctgagtgaaagagcaaaaccctgtctcttaaaaaaaaaaaaagagagagagagagaatgggccgggcgtcgcggctcacgcctgtaatcccagcactttgggaagccgaggtgggcggatcacttgaggtcaggaattcaagaccagcctcgctaacatggtgaaaccccatctctactgaaaaaaaaaaaaaaagctgggtgtggtggtggtgggcgcctgtaatcccagcttctcaggaggctgaggcacgaggatcacttgaacccaggaggcggaggttgcaatgagccaagatcgtgccactgcactccagcctgggctacaaagtgagactctgtaaaaaaaaaaaaaaagaatggactcagaggaacagcagcaagagactatcgttttggtgctccagactgttaccttgcagtgagaaagaaagaggaaagtggttgactttttttccctctatttttccctctctgtcatcctcagctcactttagtcactcaacatgtctccatgttaacatggagaggaagatgggggtgggaaaagtcttctttgaaccagtgtaatagctggcttagtgctttctgggcctcgcagatgtttatagccatctctatccatcatcaaagcatcatggggtgcttttatacactcttcaggggttccctactggcccctctcctgcagttcccttagcaaaggcatctattaatggccatttgtctagcttcttgttcctggggtccctttatacctccaggaagccctactgaacaggacctaatagtcagcaggcttgtctcttcttgctagagttcacaggcaggaagcatatcctggtcacgatactccctaagtgcaatggtatggattctgcatctcagattctcatggaagccccctctcctagtcacttggtttgagcggttaaaagtaatgtcctcttaatcttccccaaggaggaatggggactcatagccagaaatatctccacacaaattatctatcctccacctgcagacccctttatattgggataagggatttaggaactttcaaacagattttagactaacagaaaaaaaatatatatatatataaatatatatatatatatatatatatatatatatatatatacacaaatatatatgtagtgatttagcacctcattttgaaatttcacatacatatatatatatattttttaattcagttagtccagacggcctcttggcatgggctaggaggaatatgtataaataatgagcaaggctgggtgtaggaaagatccatattatagccctcagagagggtttgagtacaaggcatatttctagagatggaatttaggatataaaggaagaaaccgttcccctcacctggcagggaccagggttgattttctttcaactcatccattgcctttccctccaatccagcctcctttgagaactccccagtctggttcatcagacaggtctgaacatgatcagacttgaattgtctggtttaagtctttataggactcttgggccccaagccaggtgataggtaggaacacctgtttgtacgtctcaaatgctccatgcagtttgcagaatgcgttttttttctggttttttttcctttttttttttttttcgagacagggtcttactcctgtcacccaggctagagtgcagtagggccatcacggctcattgcagcctcgacctcctgggctcaagcaatcctctcacctcatttttttatttttttgtagagacaaggtctaactatgttgcccaggctggtctccaactcctgggcccaagtgatccacctgtcttggccttctaaagtgctggggttacaggcgtgagccactgcacccagccatctgcaggttgtgtaagactgatgtggtgtactcttatgcctacagaaccactagggcaggggtttctaatcccccaggccatggactactatcagtctgtgacctgttaggaccctggcagcacagtaggagttgagcagataagcgagcattaccacctgagctccacctcctgtcagttcagcagcagcattagattctcataggaggcaaatcttattgagacctgtgcatgcaagggatctaggttacacactcatgagaatctaatgcctgatgatctgaggtggaagtctcatctcaaaaccattcccacccacccctgcccatccctgtttcacacaccagctaattccactttgggctttggctcagataatatccagttgtactacattattatgttttaatacaatttccaacttgtccttactacattgtattattattcaatactagaacataatcaatgctcaataaatgtccactgggtaaatgaataaataagggaatgaatccccctttacaaacatcaaagattactatttggtttggtatatcttggtagtctgaaacctgtttactcctcatagtctttttctttgagatgaactttcgctcttgttgcccaggctagagcacaatggtgcaatctcggctcaccgcaacctccgcctcccgggttcaagtgattctcctgcctcagcctcccgagtagctgggattacaggcatgcgccaccacgcctagctaattttatatttttagtagagatggggtttctccctgttggtcaggatggtattgaactcccaacctcaggtgatctgcccacctcagcctcccaaagtgctgggattacaggcgtgagccaccgcacccggccgactcctcatagtcttaaaaaatattgtctagtttgctaatggatgttatgtcattaaactttgtaacactagggctgacttgattcattcattcaatggacacttacttgatacctaccatgtgtgtaagactgtgctaaatcccaggaataagtctcctatccacacaaagcttaaattttggagggaatgttaataggaaaacaaaataataaatggaaagtgctatgaaagaaacagaagacggccgggtgcggtggcgcatgcctgtaatgccagcattttgggaggctgaggcgggcggatcacgaggtcaggagatcaagaccatcctggctaacacggtgaaaccccgtctctactaaaaatacaaaaaaattagccgggcgtggtggcgggcacctgtggttccagctattggggaggctgaggcagaagaatggcgtgaacccggatggtggagcttgcagtgagccgagattgcgccgctgcactccagcctgggcgacaaagcaagaccccgtctcaaaaagaaaagaaacagaagactatcctagaaagtatagggtattactttagatagcatggtcagggaagacctagttgaggaagtatcatttaagctgggacctgaaggacaggaaggtaccagctaggccaagagctgggggaaaagtggtctaggtagctggcatagtgtatgcaaacgccctgaggcagaaaagagcttgatgtgcataatatttagattgtttcatttgtatttcaaatattgttgcagtgaacattcaagcacaatgcctgttgtgggattatttccctaggatggaatcccacaccactgcttctttgcatcgttttctctgtctagtgcctggagatgttccttttcccctctctagatagtttgcctttcagaatccgtgtccttccttccccttttactctccactttctctatttctcaaattagctattaagatcttttttgtgttcttacaggagaaagataaaatatagcttttaagcgttcctttctcaggttacctttggctgtggattaacctgaagccttgctgtttcactcgagctatccactcattcacccattcactcagcacttattgagcacctattttgtaccaggccttgtgctgagcgctatagtcagatgaccaaattacagtctctacgctcaagctcacaatctcatgcagcgcttcctaaaacgtgttcccaattatcagaatcaccctgggtactttctaaaatgcagattcctggactccacccccggtttagggattctctgggggtggaaaccaagagtctgcatttaccagttttgtttttaattcctactaaaaattgagaaccactgagtgcaagagtgaggcaggtaaatggagtttacaactctaagaaagtgcattaacaatttatacacaaggccgggcgcggtggctcacgcctgtaatcccagccctttgggaggccgaggcgggaggatcacgaggtcaagagagatcgagaccatcctggccaacatggtgaaatcctgtctctactaaaaatacaaaaattagccgggcgtggtggcgggcgcctgtagtcccagctactcgggaggctgaggcaggagaattacttgaacctgggaggcagaggttgcagtgagccgagatcgtgccaatgcactccagcctggcgacagagcaagactccatttcaaaaaaaaaaaaaaaaatttatacacaaaatgctacaggaataacgcatgggtcctattgggaagaaaaagttctctagaagtcaggcttaagcagaactgcagctccgggacggattaagtcaggtaaaggtaacactctgtgcagagacatgcagacaaaaccgagtgttgagtaagtaactcgcctgtaagtgttatgctgcctgaagcttctcggagcgtctgagcagcaaggtgaacaaccctcagaaaccggtcgcgctgccagtattatcgctaaccagtggcagcgagcccctttgtttctcggcagttgtaattgtagtctggtttgtaggtggagctgtgcgcaggcgcacctagaaccaggtgaccttgcacatgcgctgtatgtaacactgaagccaaaagcgaaatgattgagggcaatttttcttttctgcttccgaaatgtccctttcgcgaatccagagaccctgaccgtccccatttctggctagggatcttataattcttaaaataataccccctttccttcagggcctctctagtaagtcggctgccaatacccaacatggcgggaggccctgcgccggctcagtctgcctataggtgcaggacttggaggggcgggcccctcccaaagggcgggagtttggggggcggggcctggccctctgcctcggggtgggctccgcccccgtcccccgcagggccttagcagcggctgccgcagctcaatcgcggagcaactagccgggcgtctgcgggagccgagcgtggtgaggtggggcctcaggggcaggtgggaggtgctcgggttaaccgtccgaggcccggagacccgcccgtctagggcgcctgagggaatcccgttcgggcagcggcctcttgttacccgggaggaacccgaggcccagagaggggctgggacgcgtcgttagggcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgtaagctcgttcgttagatgttatgccttgcctttttcatctctagatcccagggcctagcacgtgatgataatagtcatggcttactgtacggaatgatcacaaattgtcaggtgctactgaatgcattacacataagggcccatttatttatttatttagagacggagtttcgcgcttgttgcccaggctggagtgcaatggcgcgatctcggctcacctcaacctccgcctcccgggttcaagcgattctcctgcctcagcctcccaagtagctgggattgcaggcatgcgccaccacacccggctaattttatgtttttagtagagacggggtttctccatgttggtcaggctgatctcgaactcccgatctcaggtgatccgcccgcttcggcctcccaaagtgctgggattacaggcgtgagccaccgcgctcagccaaaggcctatttaatcttcccaacaatcctatggggtgagttctttctatagcttcacgttttacccatgaagaaactgaggtattcatagaaaaagtaatttgccaggagtcccacaactaataagtggatggagctgggaaactgtccccagggcatttgatgacttgactagattgcctttgggtttaatcaacgtctgttgaattgatctttactttggccctgggagttattggaggctaggcttgtgatcagtattttaccgcgaaggcttagaaaggagaactggtcccagatttatagaggtcacaacaaaaccaaggctactggtacgccctctgttcctttagttcttctatctttctttgctccttttcgatcagaaagctgcagacataggtgtcattatcgctcactatttaagaagtgcccctcacagagctgtgagttcgtagtccatgctttaactaatgtaatgttcatgctttaacagctaatgtaatggagagagtgtagaatttggaatcagattggggttcagtcattgctctgccactgaccaagctataagttatatgcctccccccacttttttttttttttttgagacctggtctcagtcacccaggctggagtgcagtggtgcgatctgggttcactggaacatcctgtctcccaggttcaggcgattctcccgcctcagcctcctgagtagctgggattacaggcgcccgccaccgtgcctggctaatttttgtatttctaggagagatggggttttgccatgttggccaagctggtctcgaactcctggcctcaaatgatctgcccaactcagcctcccaaagtgctgggattacagttgtgagccaccacacccagcctgtttttttgctttttatataggtaatagagctgttagcattttgcaagaccattggtgataatatggatcatgttacctaatgtcctataatagtcagtaataatgggcacttgttataaaccaggctgtgttttaggtaggagctgggaatacagcattcgataaaacaatgcttttgcacttgtggaatttgcattttggtaagtatattacataataattagatagggacagaaaaagcatggtaaggtaaataaaagtactagtgttatgtggagaggtgatagtattttatttatttatttatttgagcatcttgtcccaggctggagtgcagtggcgtgatcacagctcactgcagcctcgaactccttggctcaagcagccctcccaccttaacttcccaagtagctgggactacaggtgaatgccacacagccagcaatttttttttttttaatagagatgggaatctccctgtgttgccgaggctggtcttgaactcctggcctcaagagatcctcccaccttggtgaaactctgtctctactaaaaatacaaaaaaattagctggtcgtggtggcacatgcttgtaatcccagctactcaggaggctgagacatgagaattgcctgaaccggggaggcagaggttgcagtgagctgagatcatgccagtgcactacagcctgggtaacagagccagatcctgtctcaaaaacaaaacaaaacactggatgagattaccttggaaattaatggagatggagaagaggtctgaagccttgaggtttccaaactttagatactggggagatgagaaaaggcagcaaaggagactgagtgggagaggccagaggttggaagagagcaacagagaggccccacatgagatttaaataaggagctgcatgctaatttgtttttttcaggagtaagaaacaaattatgtctgtacacaaatgtctatactgtagtttctttctcagtaaataaaatgtttgtgtcctcaagtatttttctgtttttgctttaagtgacaaattctatttaataccattctgcatcttagtccttgtagcatttatgcctctattccaagtttaggtggtagtgttgcttctcttttaaactttatttaaatactccttttgtagtattttggatgagagaggatcaaatacataatttatctcactcttctgtcactttccactccaggttcacaggtggctgttggtctttagtaagggtgctgtcttccctgtctgatccttagcaaaagtaggaaggtaggtcttgttcatttctgtaccactgtggcagactcctgatactgagttgaaattcatgagtgtttatgggataaattaatgtacaaaagaaatgaatctttccctttttcctgcagtaatgataacattggctcagtggtttacagcttagaagtacactgacactcattatcttatttagatgtaatccaatttgttacagtttgccagctactgctcttttccctttctcaggcacattgaaatttactttccctttgggggctctgctagtttattcctagcagatctgatctggcagtgtgtttgtaaaaggatgctgaactgtgtcttgaggaagctcagaatgaaatctgaatttcagaaagattcctgagataatttttctctgtctcttctcttttattcttgttttaataaattttagttttatgaggattgttttggttttaaaaaactttaaatcattttttaaaactattttttacaacaattttagggttacagaaaaattgcatagtacagagagttcctgtataccttgcacccagtctccccttttagtatggtatatttgctataatgcaaatctttttttttttttttttttttttttgagatggagccttgctcttgtcgcccaggctggacagtgttggccaggctggtctcgaactcctgacctcaagtgatccgcctgcctcagcctcccaaagtgctgggattacaggtgtgagccactgtgcctggccatgcaaatcattttttgagataagtggggcatataaaaatataaacaaaatgaagttgctttatctctacaagcctcagtttccttatctgcaagatgaggggggtggactaaatttctaaatagctttaaaattttttaattatctgctaaagtaaaataattatataattgtaatataattttctttatttgcttaagtattactaataccaccttgccaaatcatgtttgcaagttactgacagccatatcctaaaagaaaacttaatgagaattcatggaactatgtgtggcaggactgcttattagagatattaggttgaatgatgtgaaattgccatttttgtagataaaaagtaatgagtgaggctgggcttggtggctcacacctataatgccattgctttgggaggcttggaccagggggtggctgtctgaaaccaggagttcgagacaagcttaggcaacatggcaaaaccttgtctctaccaaagaaaaaaaaaaaaagcctcggtggcacacatcttcagctcctctgaagggtgaggctggaggatcccttcagcccaggaatttgaggctgcggtgagctatgattgcaccactgtactccagcctgggtgacagagctagatcctttctctaaaaataataataataataggataatattagcaatttcatatggttcaacctaatgttttgggatagggattcaacaaagtgtgagggggcctttgagacctcataaactcccactgcatgcaaaagcccggctcagccctcaccatactaggagagaaaaggctcctcagttcccttggagtaacttggatctacattattgtaggtagagttgttggcagaaatcctgggataagagaatagtttcctggaagatctgtgcctccaaccagcagagagggattgagcttcattgaactcaacagagccaacatttcatagcaccatggtgagttggtcacacagccttggcaaaaaggctgaaaaggagggtgtaatagtatggggaaaggttgtattcccctggttcgtaggctaggaagaggcctggagtactggtgccaccaaacctttattggtgccattctattctccctactttatgcactttccttactgcctagtacaggctctgcaaactcaagtatcttcggttgttcaggaggtaatgtaaattagtaagccgagttttcctctttaatgctactataacagaaacaatagcacagttgcaatgataaatgacaactgaaatatgctatcattgtgagggagagaatcggtgtgtgcataggggaggccatgatgaactggagagcacatgccctgtctaaagggggcaggcactatacaactgtgcagagcacacgccctgtctaaaggagacaggcgctgttcaactgcacggagcgcgtgccctgtctaaacgggcaggcactattcaactgtgcagctggttgttgccttattgaaatatgggtcaagcatcactgggtattctgattttccaaaggagccagaaatatggattttatgtacattctcccaatgataaatgttggcacctaatttgaattcttaaaaactattatgtgggccacacaatggctgaaaagagctagcagggcactgatttgtcatctctggcttatggcttagctctgccaggagtgaggctcacatgcatttcttcactggacattgttgacaagttacaattaaaatgaattagacagctcctgcctttgaggtactcatggattagcagagaaaatagacaagtaatgatgataagatgtagagtagacatcagaacatatgtattctctctgtgtatatagctataaaagtgactaactcttcctgggttcatctgggaggacatgataggacgtggcatttgagccaggatgtgggaaatcaatagtttggtgcattaaagggatttggggcccttgaaatttctactgtatgtgcaaatgttaggtttgcattcgctgtatataccattttgttgataggtagttgaaaatacggatattccttagccctgctggtgagagtcttagggttaataaaatgagagaactcttcctctggcccaggttatgggataattgtgtgttttagaggcctaagtaactcagaggtcatgataccctcatttctggatgagggaagtagcacatctgaggtcacagagcccattggaggcagagcttggactaacacccagaactctttaccaccatgccttcccctgtcctgggtatctctgatgaaggtcaccgttaggctggccgcctctgcctgtggtggcccattgccctgttttggcccagctcctggtgggtgagggggtttggccatcctgctgccactggttccttctctcttttggatcctttgcctgaaatgcctgctaccccttttctttgtcagatagactacttgtgttcaaatctctctcaaccatatgccagctgtgtggcctggcacaagttttttaacctttctaagccccagtttcctcatctatatataaagagttataatagtacgtttggtgaagtgtaatgagaaggcattggaaggtttcaagatttttgtaaaaacaaaatgacgtaatgcatgtaaagcacttaaagcaacagccctccagaagcactcagcaagtgttaacaatgatgatgatgattcacacagttcacaggctcccaggctgggttaagttctcttcctttgttttctcatattatcttattatttcacatgctacattgtatgtattgtaatagtttgtgtctatttcccctgctagactaagaacaccttcagcgattcattcaacaaatgtttctgaaccactgtgccaggaactaaggatgcagtgataaaccaggagctcttggtttagtgcagagttccaaaagtcatgccaggagacactagtcctgtgagcttgtctcatggtcagttaaatttggggaatgatgctcatcatagcgcccttcagagatgagggtcccttttagtattttaaaggttctgaggagtcttgtgtgtagtaaaagaacagtcctttccatttgactatgtgctttggtccccagttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgaggcagctgcccttttggggaggggaaagagaacaacccccagagctaggtgctgaggtgagataagggttgcaggaggcagagtcttgtggtgggagtggcctacatctagcatggtgagataagacccagaccttctagctttcatgtacagcttctcttttgatgctcacaactgctccatgaggtacgtattatatccttttaatttaattttatttttgagatagggttttgctctgttgcccaggctagagtgcagtggtatgatcacagatcgctgcagcctcaacctcctgggctcaggcagtcctcctgcctcagcctctggagtatctgggaccacaggtgtacaccaccacttttggctaatatatctctttaaagatgaaattcacaagggttaagttaattatccaggtttcttcagctagtctagagccaaagcccatgatcttgcctctgtgatataaaaggcatatagaaagtatttatttatttatttatatatttttgagacagagtctcgctcatatagaaagtattatttaaatgcccaaataaggccaggcacggtggcccatgcctgtaatcccagaattttgggaggccgaggcaggtgtatcacctgaggtcaggagtttgagaccagcctggccaacatggcaaaaccctgtctctactaaaaatacaaaaattagctgagtgtggtggcgcatgcctgtaatcccagctactcgggaggctgagttagaagaatcacttcaatctgggaagcggaggttgcagtgagccaagattgtgccactgcactccagcctgggacacagagcgagactccatctcaaaaaagaaaaaaatgcccaaatagaaactataagatgttatggccttaccttactgtcaccacccatttcccctgttcatagcaagtttgcctaagatcctcaggggcctttgctttgggctgtttgtgccagctgtgttcattgcccagggcctgttctttttgctgcaggtgctgcagtaccgaagctggtgccaagagctggagaagcggctagaagccactggagtgagtgaggctgagctctctgcaccccctgggtcctcagtgaatatacttgttaggtttcatttgttgactgagggaggttggagtgtacaagtgaggtgtttggtggaaggctctctttctcagcctctgagaggtttatcacactgatatcttcattggacctagctggcctgtcagattccaacccttggttttcaaaggacgaaatgtaaattagattggaaggagtgtgggattagcaggaagaagtgcatgtttcctccagcaggtgtcagtgtttcttttagaaagatgcaggcctttgcgagcctacagcatgtctgcagcaaagggatgtctgtgctattagaactggctttgaaaaacccatttatttgcctttgttccagctgcctctcagtacctcctcacattttcctcagaaaagttctctcagaggaaggaaagaaccaaaacttattgagcaccctcaatgcagtccaggcagcatgaggcactgtcatatacagatggtcctccccaacttaggatggttgcaagttttcaactttatgatgatgtgaaagctatatgcattcagtatgttccttgggttatgatggggttacagctggataaacccattgtttggggttgttttgcttgcttgtttggttggtttttgtttgtttggttggttggttgttttgagacagggtcctacttactctgtcgcccaggctggagtggactggtgcagtcatgagtcactgcagcctcagcctcctgggcttaagcgatcatcccacctcagcctcccaaaaagtagctggggctacagatacatgcctcaacatctggctaattttctttattttctgtagacacagggtctctctatgttgcccaggctggtctcaaattcttagactcaagcaatcctcccactgctgggattacaagtgtgagccactgcatctggcccgaactcactgttaagttgaaaatatcataagttgaaaatgtcagccaggcgcagtggctcatgcctgtaatcccagcactttgggaggtcatggtgggtgggtcacaaggtcaggggttcaagaccaacctggccagcatggtgaaaccccatctctactaaaaatacaaaaaattagccaggcatgatggtgcgtgcctgtaatcccagctactcgggaggctgaggcaggagaatcacttgaacccaggacgcagaggttgcagtgagccgagatcatgccactgcactccagcctgggcaacagaactagactgtctcaaaaagaaaagaaaaaaagaaaacgtcgtaagttgaaaacacacctttaacttatgttcaacttatgatggatttatgggatgaaattccagcataagtcaaggagcatctataattgtgtctcttaacctgcacagcaactttctgaagggaacgatataccgctttcattttgtagctggagacactgtagctccaagaagttaagtgacttcacaggctgggtgtggtggctcatgcctgtaaccccagcactttgggaggctgaggtgggtggatcacttgaggccaggaattcaagaacagcctggccaacatggcgaaaccccatctctactaaaactacaaaaattatccaggtgtggtggcaggtgcctataatcccaactacttgggaggctaaggcaggagaatcacttgaacctgggaggcggtggttgcagtgagctgagattgtgccattgcactccagcctgggcgacagagcgagactctgtctccaaaaaaaaaaaaaaaaaaaatgaaagaagttaagtcacttcccaaggtcaaaccgttagtgtagtggaagttaaggccattagtgaaagatacatcacttcttaagttgaagattctatttactactgaaggccgtctttcaggagaggtcatcagtttacttttggagtgagggatgcagtgattgagaatagaagcatattgctaacaaaggggagaaagaataaaaagaaagtggactgccatggaagggagccttagggaactggtctgagtgatgttctctttggaggtaagtaaggcttgtctctgtctggcgcagggaccaatcccccagaggtgggaaaatgtggaggagccaaacctggatgagctgctggtccgattggaggaggagcaacagaggtgatggaccccaaactttctgacctgggtgattggccagttggtggagaaggctgatgggaaacttctgccctgagggctaatgtggacttcagccatagccctctaattcctgcaatggaaaatttcagtggttgccatcttactcccaggaggtccaagggttggactagacctttattttgcacccacttttacccctccccagtgcaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggaggtaggaagaacggggactggaactgtgagaggaagcctgtgtattctggatgctgccctggtcagtactggaaggagttaacttcaggacttggatgaaaactgagctgttgctgttaaagtccctgaccatccttacctgcgcatgctggcagcctcagccttcttgggccttcagcttagacctgccactacccgcctagtctaggttctgctgggaggtagcatgacactcagagcaactctgttcctgcagcagtgacgagcttaggtttttgatggatctgaaagcttactgattcctggtctggaggtcttgcatatctagatgctaaggaggtagatatgaaactgaatgggaaagaaagagctgttatgggccctggggaattttcaggtcccagctgaaggaaacaaatgtttcctgcatttttgctttgtgctcagtggtttatgtatatcattgactcctccttagaaaagtctgtggtaatagatcccatttgttaagcagctaccgtgtatccttttctaatctggcccagaggaaggcgatataccatcctaggccctctgacctgtcgaatcccactgccaactttattaagcccttcaccataacctggatagatacccattcataaactatctcctgtaagtccctccttccttccctcagtagtcaggaggaatccaagactcttgtgttggcaaaagatagccctctgcctttgggtatgacctgggtttctgaacacacagttcttcaagggctacctgaaaggggagcacggtcgccttctcagtctatggcgggaggttgtgacattccgacgccacttcctggaaatgaagtcagctactgacaggtcagtgtggggagaagaagggaggaggtttgcccctaccaattctggactaataacagtgggctgctatagaagcgggatcagctgtgggggtggggtgggtgggggagttggtagtattggaagcagatgatttttcccagccctgctcctcaggcttcactgggcctgatcaccacactccttccctggttcctagtggagtctgctgttttccttgcttgtactcagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccggtgagatggcctggggtcccaggaagggttcgctgagagagagctgactcctttagagggttagggacaggcagggggaggtgccaggaacattcctaccatggagggggagaagatgtgcccaaggaaatctactttgaaacctgatgccacagttggggcttgtactgacctctgccctcagcctgtcttttagcccagtttctttcctgttgatttatggagctagctatgactccatcctccatcaacaccaaagtgcttgccattcccagaacagccaagctcttccccctccctgtctttgtacctgctgaatttagtctggaatgcctccctcccttctctctctgccttatcctctaagacatagttcaaatattacctcttttttttttttttttttttgagacggagtctcattctatcgcccaggctggagagcagtggcatgatcttgcctactgcaacctctgcctcctgggttcaagtgactcccctgcctcagcctcccaagtacctgggactgtttacaggcacatgccaccatacccagctaatgtttgtatttttagtagagacagggtttcaccatgttggtcaggctggtctcaaactcctgacctcaagtgatccacctgcctcagcctcccaaagtgttgggattacaagcgtgagccactgcaactcgccgaaatgtcacctcttctatgaagccttctctgacctcagtagcctgctaagttactgtgcccttgtagtcttttgacctcttattacagcattgatctcactgatgatttagtttcccctaccttctttttttggtgaggctgttttactttttggattataatgaagtaggtttttaaaaaataatgacatagaagggcagggaaatgagcagagagccccattgaatctcaggacaaagttcatatatgcccatgacgagggttgtatcttcacctgttggaggtacatacataaaatgcagggctattttgttttgtttttgcttttggaggcactgagaagtacaaaagcaggccatgtcttcgtaagtttttatttctagtactttgtacttcacctgccgtatactagacactcaatacattttgtttctttgttttttgagacagagtctagctctgttgcccaggctggagtgcagtagtgtaaacacagctcaccgcagccttaacctcctgggctgaagcaattctcttgcctcagcctccaaagtagctgggattacaggcacgcaccactatgcctggctaactttttaatttttttgtagagacggggtctcactatgtttcccaggccggtctggaactcctgagctcaagcagtctttccaccttggcctcccaaagttctaggattacaggttgagccaccgtggctggccagtgaatgtttgttgagtgatgcaatacttaaacaaatgaccatacagtgtgttaaggttcttagagatggtatagaataaaattattaagacttttgctgagtgaggaggatcacttgagcccaggagtttgagaccagcctggacaacatagtgagaccttgtctctactaaaagtaaaaataaaaaaagaatagccatgtggtggcatgcacctataattctagctacttgggaagctgaggcaggaggattgcttgagagtgagctatgattgcaccactgtattccagcctgggcaacagagcaagaccctgtctcaaaaaaaaaattggaaaaaaatttaaacttttagatagcattcattcaagaaatatttatttagccactcacataatagcaagcagtaagctctaagatatagtgttaagtgtttggtgattttgctggactttgagattaatatcaagaaggttgaacataatcttccccaaattgcccttcctttttccctatcagagtcagaacctcgggctggagggaccttgggactatcccaagtgcaattctgatgttcttattggcttcagggtgcttgacttcaagatcaagcgaggcctggaagggcctgggccagggctttccttcagctcttgggcccccaaacacgtgttccagccttgagatgtggtaaatccctgcatgtgtctgagtggttttttgcttccccacttcaaggctatagcatcatgtggtattcagggagtgcagacgggctgggggtgcctaagggatttgggggaggctgcagttgggagtggttggggttggggctggggctggggtgtgctgcatcgtagctctgtccacatccatgggctgttctggtgacagtgctatgctcttctctttagggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctgaaaattaattaactcattcatttattcattgaataaatactattgactgtctactatccctactgtattcctggggaaattgcaatggcatatgtatgcagtgtgtccttaccagagaattggcacatacattcagagacacattggcaaattagtgagttaccaggaagcggatatgtggagagatttaaaatctagtcacatgggaaacaactgaggagtatggcaatgtttagccgggagaagaaagagcttgaggccctgtgaaggcccttgaagacatgatagctgccttcacatatctgaaggactgacgctgggaaaagagagtttatgaagggccgggcgcggtggctcacgcctgtaatcccagcactatgggaagctgaggcaggcagatcacctgaggtcgggagtttgagaccggcctgaccaacatgcagaaaccccgtctctactaaaaaaataaaaaaaattagccggtcgtggtggcacatgcctataaacccagctgctcgggaggctgaggcaggagaatcacttgaacctgggaggtggaggttgtggtgagccgaggttatgccattgcactacagcctgggcaacaagagtgaaactccgtctcaaaaaagagaaaagagagtttacatatttaatgttttccagggcaaaaccaatgtcaatagctagaagttaataggggaatagattctggctcacagctagagctgttcagtagttgaacagcctgtcttgtgaaggagtaaggttttggtcattggcttaacatctgccagggatgttatcagagggcttctctaaggttggatgttagaaccctctggcttaataccatgtttcatctctataagttttcagatctctgattttaggtagctcctgaacccctattcatatgcacacccctagtcttctcatccaagctgagatcaacaggaattgtagctttctgattccctctttttttttcaggaacttgccaattcagaatatccatggggctcagataatgtaaataaatgaaatgggttcagttgtaagaattctggttttccagtgctgtttgttgtatttagttttcagtactgcaggggacacttgagctcagtattaaggaagccatgaggagcaatagggattgtgggaccctcaataataaatgtctcatctagatgaggcatctaccattcaacttcagtaaatcgtttccatgtaggaatgggggctgggtgtggcccatttgttaactttttgggagaagccagaaatttatatttttatgtaaaatctttccatttataaatgttgattcaaattttgtataagccaaataaaacatagttgcaagtctgtgtctttaggtcttcactaacacaaataggaaggaagagaggaactcttgagtcttcaagattatgtctagctttggggctagaggattctctggtttagtattaggtctcaagcatccatttactgttcagagacagcacccatcccctatctaataatagtttacatttattgaacatttgctttgttccagacactatattgaataatttacatgcatttttcatttaagcctcaaaacaactagttgctgtaattatttctattttaaagaaaaagaagtaagtgatagaagctagtaagtgatagagcaggaattctaatctgtgaagtccaatttggaactcataatcacttaatctaaacttgtaatcaccacatcacattgtcttcagactcttcagacaacattagcattgacatatggtcagggaaaaagtggggctgatagaatagacagaatgagactttggttgtttggggtcctggaataataaattcacttttgagagtttggctctgaggctctgttctattccctgttcaggagacaaatcacacagaattaatggaacatgaagcatctcttagtaggaatgcgcaagaggagaagttgtctttacagcaggtgatcaaggatataacccaggtactgggaagcctcctgttcatggtaaccaggttatgcctccactccccaggtctccatgtcctttcagtcctgcctagatttccagtctctgaggttcgggtgcttaaagtcttgtggggatgagttttgtgtgtttgaagaccagaaccctaagagatagctaagcattcacgtttagcactacctgatgggacaggccctctttcctgtttctagctgcagttctcaggctggaggctagattctggtattcaatatctcaatcgtttcttctttcatttcctcatttattgttacctcagacagtgttctagccttgttgttagtcctagacttgggtgaccaaaggtggagagttgaaggaaccagacttttatgctcagatactcccctccttcccccaggggagaggacctgagaaggaaaacatcaggtttgtccaggctatagggttaagtccctctatagactctaggctttggtcagtagggtggtgaccttgctgtattgggtttcaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggtaggaaccctcagcattccacctcagtcacaggggtttgtgtctaaactggtttgtgcctcaggtacctccctagcctggactatccctttcacttttttgaccagtcatgaggtgttctgtcaatatcccagagtaaatctgcctatgtctgctgaattgtgcttgtgagtagcaggcacatcctccacgccaatggcatgcttcactttgtgtacaatctttgcataacagtatgcaaagattgggaaccagagccctgggagattattgggtcaacgttctccaactctgagagtcttaggcacacttaccactcccccatgccactgtacatttggagatgacgaactctaagaatctagagccacagaagcccaatgacctctgatggcctgtcttcttgaatagttgcatctcccttctcagctttcttttgttgcaccagcccccgacccccttctccagccccactttcggggttctgacatccctcctttgcccttgttcatcatctggtttctcttgctctctctccacaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaagtgagcagacgggctgttcatcccaccctcccagcctggtctcagtctcagtcaccatccagccatttacccactcccatcaggtttttggggtgctgatcctgttctccttgagactcagggctgttttgcccagtgtttcacttgtttctccagaacaagcttttggggttggagtctttgtgatgataaaaaagttttgcactagaaacagaagatgggatgttgaaacagggtctcttggccctgtgatgcctgcttccagaaagaattttaggtcctatggtctctgctcatctctgattcccttcttccagggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtctgtaagtgagactagtctcctcctcgctgggccctggtctttcttcaattctacaccctccccgtctactcccctctgttacaaagtagagtatgtagaagtctggcatgcagtgggttcagattagcttgctgcttcttcctttgcagaaagatgaatatggaaagttcgtggttggttaagtcttagttgagcacccatatgggatgagacactgagggggatacagaaatgaataagacaaaagccctgatttcagggaacttgccagaagacagacaactcactgtgacatgaggctggatgaagtatgagttaaatagagtttcagaccaagtcctttgggagcacaggagtgacagctaattattgaagactaggaaatgctttatggaggagagagtagactttgagctgggcctttacctatttggttagcagagagtgggagaagagctcaaggaacagattagcaaagaaaaggcggcaggaaggttcatggcatgttcagagtaggctgggctggctaaagggtaagacttatacagggaagtagtgggaaatgtgctagctggtcaagaaagggaaatccagaatcaatggccccagctaatctgtaaattcccctatatgatgtcacagaaaaagcaaggactttgagctaggcagaagcttagtttaaattatggctctgtcacatggacagattatttgtagaatgatgataatatttaccttgaagggttgctgggaagatgagagcaacgttttggaaaacgccagcatagaacctggcatatggtaggtctttaataactgggagcagggatataccttcatctttgctgtatttccctcctctcctgtgccccagttccttgtacctggtaggcatgaatagtggaagcttgaagggctgccataagggtcatgacttgtgctaagaatgatctccctgtaccaaggagaagggcagacaacccctaacaacaaaaaattagctgtagctgaatgtggtggcatgtgcctgtagccatggcaaggtgagatgggaggatcacatgagcccccaggagtttgaggcttcagtgagctaagaagatacacagagaagtctcactctcatttgtgctttctccatcccatttcccttccccctttaggcaaccattttagctgacttcttgtttatcttgccagtgctccttcatgcaaatacgggcatatattctttcttcccccactttcttgcataaaaggtagtgtatcatgtatatactgttctgcaccttgatttttttcacttgacatgtcttagaaatctttccttatcagtgtttatagaccatcctcattctgttgcatagcaaaggtgattatattcctgttacctttggggttatggcccatccctaagagttcctctagacccctctctttcccatcttagtcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggtgcgtggcctcctctcctcacttgctgggtgggcggcttcgaaagtgtgttcccatgcagcctgcctcattcttcaccttcaagccaggatccctcatctttcctcaatcattagtctgcttctgggttctctattccaacataccctctatattggaattagaatgggctttctaaagtatatacctggttatgtcagtctcttaaaaccattcaacggctttctagctctgtggtgccacattcaaagctttttgtcatgtgcctcaaagtgtgttttagcctccccttctactgcaaaacccatcctaacacctcatatcctttgctcctgccacagcagtaattgccttctcagttattccatgttcttcatgactctaatactctgcatgtacttttccctttctctgcactacttctttcctcttcctttatgtgcaaactgttcctcatctctcagtacacaacttaatcgtcaactcctctaccaagcatatttgactcttccaaactatattaatattttttttagttcccagagcactttgtgcttacattttctgtggcatcattacaatcatagtcatttctctatcctaactttggtatctctatactgtgaggtcctgtctcactccttaatgaatgaatgaagggaaaacttgtttagaatgcaggagagggaatggagtattaactgatctctgtaccaaaaagcagcagtgttgggaatgtgaactgtttactgttccaggaaaattggaaatatgaaactctttaatcctttttgttttttaggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccaggtgagcaaagattttcctggtccccacagaagggctgggccctaactgagagcaagacggatcagctcccaaatgtaggtctgaaatgagcaaaaggaacatttacaatgcagaggagagcaaagactgtaaggattgggcttagccattataaatattcccctcccacacctccagcagaaccacctctggacttcagggtaagacaccaaggttgggaaggggcccatgtcctctggaaggaagactaggttttttgctggggttttcttgagatggatctccctctgtcacctaggctggagtgcagtggtgcgatcttagctaactgcagttttcatctcctgggttcaagcaattctcctgcctcagcctcctgagtagctgggattacaggcatgtgtcaccacacctggctaattttttttttttgagatggagttttgctcttgttgcccaggctggagtacagtggcacgatcttggctcgctgcaacctctgcatcccgggttcaagcaattctcttgcctcagcctcctgaatatctgggattacaggcatgcaccaccatgcctggctaattttgtatttttaatagagacagggttttacgatgttggtcaggctgttctcaaactcctgacctcaggtgatccacctgcctcagcctcccaaagtgctaggattacaggcgtgagccaccacacttggctgccctgggctagtttttgtatttttagtagagatggggtttcaccatgttggccaggctgatcttgaactcctggcctcaggtgatccatccacctcagcctcctgaagtcctgggattacaggcatgagccaccatacccggcctaagtctaggttgttaatcctgttgggtgagataatagcaatcaccagaaaagaatctgctgaagagcctaagtcccaaagaatcttttctataggttataaatttaacctataattatagcgagggaacctccttgcaatctctgtttccttgagtgttctctattccattattctgaattatttgagagcaggactttgccttgcatatctccgtccccagcatccagcccatctagtacctggaatataggcactagatcaaatgaatggattttcccccatcttataaacactcctttgttcatctttggagaatagattcatatctcacttggatttcagtcttagcatttgattcctaaactaaccatttgtctttgatgcttgtactcccttccctttttggccagtagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgaggtgagaagccaaaatggacaccatcatgtctaggtgtaatatatgctcattataaaaaattaaaacactacagaaattatctggaaagtgaaaaagtcttacttcctagaaatgaccagtgttactagtttgcagtatatcttccaattttaaaaaagaatgcctataacaattcttcactgaggctgggcgcagtggctcatgcctgtaatcccagcactttaggaggccgaggcgggcggatcacgaggtcagaggttcgagaccagcctgaccaacatagtgaaaccctgtctctactaaaaatacaaaaattagcccggcatggtggcacatgcctgtaatcccaactactcgggaggctgaggcaggagaatctcttgaatctgggaggcggaggttgcagtgagccgagattgtgccactgcactccaacctggatgacagagcgacactgctcaaaaaaacaaaaagaattcttcactgattctccactacttcattcacaccacccagtttgaattagaagcttctccttatactctgatagcacctcatgcttattttaactaccacattcctcatgctataattatctgtttatatgtctctaccattagaccaaaagctccttgaaggcaaagctatatcttatttgtttttatttctccagcttttagcatagtgcctaccacataacaggggccaagtaaatttttttcctgagccaatgaatgacctggctcaaaggtcatctttctcctctacaaaacctctcattgtcctaataattgtacggactctcccttcacagagtccctttctcgggacattgatgactttcttcccagtattatgtgtgcatcttctcaaggccaaaacctccttaggggcaggtcttctgctgtccctagcacagggtcttgctcacaggggagcattcttcctgggctgggggctctgtgggcggatcagggaaatagataaatgccacgtgctattgggtaagcaatccgggctcacagagctgggtccagaatctctgaagaggcaatgaccctaacctggtggtagcggccccaggggaatccagcctctgctccatctctcaccacattcttcccctcagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcaggtagggcccagactcagttcagccaagcacagagagagctttgcaaggcaaaggcgtgaagctaagctccctgccataagtatgcaggtcctaaattgattatgaatttataattgcccccctaacttctccaggtagccaatacttagaacccagctcctcttgaggaagggtaaggggcttgatgggtaagaaactcttctgattcctgaacctcacagctcagccaaggagctactggagagcagtctgtttgaagcccaacaacaaaattctgtgatagaggtcaccaaggggcagctggaggtccagattcaaactgtcactcaagccaaggaagtaatccaaggtgagaacccaactgggatgggatgcactccattccatggagatgttgaaaggcaggaagatggtgggagactattagaggtccttctccagcagggtgcagggcctctgagatgggagttgctcatgaggtcaggggagagggagaattttattaggtaaaaggagggggcggaggcctgatcctgtccctggcatgttaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggtaagtggtcaatgtggccgggtatggcctcccttccatgagtgctctacctgctgcctcttggtccagttattgctgctcgtatgagtgaaattttgtaaccaagctgtaaaatccaacttcctgctattaaatgagttaatatatgaaaagcactaagagtagttcctagcatgtggtgggctccctatatgtgttagccattattattgttgttgtgttggtgtgtacagagaattgagagtggaccctgggatttaggattattaaactggcctcaggatgaaaacgggggagaggaatatcttggatgcattcttgtgcagttcagaactgtgttttgtcttttaataatgtaatttagtccatttggttttattgtggttttaggtgtatttggatttatttgtgccatcttatgttatttgtcttgcttttttatatcttttttttttttttttttccttgagacagtctcactctgtccctcaggctggagtacagtggtgcattcttggctcactgcaacctccgcctcctgggttcaagcgattctcctgcctcagtctcctaagtagctgggattacaggtgtgtgccaccacatctggctaatttttgtatttttagtagagatggggtttcaccatgttggccaggctggtctcaaactgacctcgtgatccacctgcctcagcctcctaaagtgcagggtacagctgtgagccactgtgcctggccatttttatatcttttagggaggggaaatctcctttcttaacttcttttagaggattaagttgggtgattaagttgtattcttttctcacctcttttttctctctgcaactgtggatgatatatactttattttaaaaatcctgttagtggttacctttaatatttttaaacatatacttaataaaatctcaaggttcagtagttttacccttttcctgaacgatacaagggtcttagaacattttacctgggccagggacagtggctcatgcctgtcatctcagcactttgggaggctgaggtgggcagattgcttgagcccaggagtttgagaccagcctggacaacacggcgaaaccccattccctacaaaaaaaaatacaaaaattagccaggcatggtggtacacactgtagtcccagctacttgggaggctgaggtgggaggatcacttgagcctaggaggttgaggctgtggtgagctgagcaccactgcactccagcctgagtgacagagtgagaccctgtctcaaaagcaaaaaagaacattttacttgtttcactgctccctaatttataggctattttgttcagtgtgttcagttctaactagtttaacaccacaaattatgatttttttattgttttatacagtcaatatttgttcagatacaacgaattgataccttttctgttcaccataccttcttgcatgtcagactttctattcagattttttttttttttttttgcctgaagtaggattttctttggtaagggtctgttggtagttaattgtctgaagatgtttctattttatttttattcttttattgaggcagggtctcactctgtcgcctagactggagtgcagtcatgtgatcatggcctactgcagccttggcctcctgggctcaggtgatcctcccacctcagcctcccaagtagctgggattataggcatatgccatcacacccagctaattttatttttggtagagacggggtttcaccatgttgcccaggctggtctcaaactcctgggctcaagcgatccacccgcccttggcctcccaaagtgttgggattacagaggtgagccaccatgtccagcctacttttattcttgaaagatagtttctggctttgttcaggcttaaaaaatagatagatagatagatagatagatagatagatagatagatagatagatagatagattcactaagtaaaacattcagatataagtttctaggatgacaattattttctctcaacattgttggtattgagaagttagctttcattttaatcattccacagtttcttgtgtttattattatttttttgtttgtttgttttttgagacggagtctcgctctgttgcccaggctggagtgcagtggcgcaatcttggctcactgcaaggtccgcctctgggttcacgccattctcctgcctcagcctcccaagtagctgagaccacaggcgctcaccaccatgcccggctaattttttgtatttttagtaaatacaaaaattttttgtattcaccgtgttagccaggatggtctcgatctcctgacctcatgatccacccgcctcggcctcccaaagtgctgggattacaggcgtgagccaccgtgcccggctatttatttttttatatatttttttattttttatttttttgagacagagtcttgctctgtcacccaggcttgagtgcagtggtgcaatctcggctcactgtaacttccacctcttgagttcatgcagttcttctgcctcagcctctagagtagctgggattacaggcacgtaccaccatgcccagctaatttttttgtatttttagtagagatggggtttcaccatgttgcccaggctggtctcaaactcctgggctcaagtgatccacccacctcggcctcccaaagggctgggattaaaggcgtgagaccacgcctggcaatttcttgtgtttagatgtgtatttcttttatttggttggaatttcttagacatcctgaatttaagatttcatgttgaaatatcaattctggaaaattcttatatattatctcttcaatattacctctttcctactgtcctgcttttatttatttactctttaaaataaatttttttttggccaattgcagtggctcatgcctgtaatctcagtaatttgggaggctgaggtgggcggatcacctgaggtcaggagttcgagaccagcctgaccaacatggagaaaccccgtctctactaaatatacaaaattagccgagtgtggtagcacatgtctgtaatcctagctattagggaggctgaggcaggagaatcgcttgaacctgggaggtggaggttgcgatgagctgagatcgcgccattacactccagcctgggcaacaagaacgaaactccgtctcaaaaaaaaaaaaaattttttttttttaaatttattttattttattttttagagacagggtcttgctctgttacccaggctggagtataatgatacaatcatagctcactgcagcctcaaactcctgagctcaagtgagtcctcctgccgcagcctccgacgaactgcaactacaggcacatgccaccatgcccagctaattttttaattttaattttaattttttttttttttagagatgggtcttgctatgttatccaggctggtctcgaactcctgggctcaagctgtcctcttgcctcagcctcccacataagctgggactacaggtgcacgccaccatacctggctcttttcctactttcttctctctttctgtactctggttagttgtatgtcagacctttttactctatccttcatgtatcttcactgcctcttgcattttacatgtttacttttctctttgtatgctgtgttctggattatttttttcagatctctcatctagttactgattttccttttcagctgtgtcgaatctgatgtttattctattcaccaagttttaaatttcactttttaaattttttatttctagatattttatttggttattttttcatatcttcttggtcatttttttcagtctgttttccctaatttgtattttcagtccattcttttaaacatatgaaacatacttgtgtcctgtctagtaattccaataacttttaattaacgttttggggtctagttctgtaatttgttgtttctgttggctcttactcatgggcttgtttccctgtgtttttgtgattcttgtctatgagcatgtctttggaaattttcctttttttttcttttttctttttttcttttttcccccagagacctttgttctgaggaaggttttctgtgggaatctttttaggcctgaggcaaaggagtttttcctcagaggatttgtgcttctgtcaggaagctggaggactagcatcccaggaccaccttaaagtaaattttctgtttaaagttttttgacccacagtcaggcccagaccccatgtgcagctcagcttgtggttatgaattttcagaggagacttttttcctaccctgtatcaaagttgagataagcatatttccttgataatttccttctatagagtttattttgttttgtcccctctccacatccctccagtttctctttttctcccttcctccccatgtcctccttctttttgccttttcccccttaagctgaggtcactacagcccagagataggcatttttttttttctttctagagatggactatcactatgttgctcagtctgatcttgaactcctgggctcaagggatcctcctgtctcagcctcctgagtagctgggaccacaggcacagtccaccatgtctggctttttgttaaggactatatgctaggctttgcagaccatatggtctctgttacaattatctaactttgcaattgtagtgcaaagcagccatatataaacaaatgagcatgactgtgctcagataaaactttatgtatagatactgaaatgagaatttcatataattttcgcatgtcacaaaacattattgttttctaccattaaaaatgtaaaggctgggtgcagtggctcatgcctataatcccaccactttgggaggctgaggcaggacgattggttgagaccaacctgggcaacatagcaagaccctatctctttaaaaaaaaaaaaaaaaaaaggtaaaggctgggcgcagtggcttacgcctgtaatcccagcactttgggaggcctaggtggccggatcacctgaagtcaggagttcaagaccagtctggccaacatggtgaaactccatctctactaagaatacaaaaatattagccgggtgtggtggcacatgcctgtagtcccagctacttgggaggctgaacaggagaatcgcttgaacctgagaggtggaggttgcagtgagccaagatcgcaccattgcactccagcctgggcgacagagtgagactctgtctcaaaaaaaaaaaaaaaaagtaaaaaccactcttagctcatagccagagagcaacaggtggtgagccagatttggtccacatactataatttgttaaccccagtccagatttttgtttgtttgcttgttttgtttagagataaggtcttgctctggtcacccaggctagagtatagtggcacagtcatagctcactgcagcctcaaactcccaggctcaagtgatcttcctgcctcagcctcctaagtagctaggactacagcgtctgcctggctttttttttttttttttttttttttttttttttgagacagggtcttgctctgtcactcaggctacagtgcaatggtacaatcatggctcactgcagcctctacctcacgggctcaagtgatcctctccagcctcctgagtagctgggaccacaggcatgaaccaccatgcctggctaagttttttttttttttttttttatagagatggggtttcgtcatgttacccaggctggtcttgaactcctgggctcaggtaatctgcccaccttggcctcccaaagtgctggggattacaggcgtgagccaccacgcccagccacctggcttatttttatttttattttaaattctgaattacatttgcattgggtgaaagatagtggatttacttttttttttttttttttgagacacagtcttgctctgttgcacaggcagtggtgctgtttcagctccgcctcctgggttcaagcaattctcgtgcttcagcctcccaagtagctgggattacaggcgcatgctaccacacctggctaatttttgcatttttagtagacactgggtttcaccacatcagccaggctggtctcgaactcctgacctcaagacaaggtcttgctattgcccaggctggagtgcagttgtacaactgcactgtacaactctagctcactgaagcttcaagctcctgggcttaagcaatccttctgcctcagcctccagactagctaggactacaggcatgcaccatcatgcctggctaattttttttttttttggtagagatgtgatctcactttgttgcctaggctggtcttgaactcctagcttcaagcaatcctcctgccacagcctcccaaactgctgggattataggtatgaactaccacacctggcctacaccacaagtcttgctttgcttttggcttctgtggaatttttattattttcctgctggttctgtgatacattaaaatacatatttaatattttatccagcattttttgcgatttcgtagctggagggttcagagatcttgtttatcaagtatctggaaatggaagttgacttgtgctttatgtgtatttgtaatttgattgttattatgaggcaggcttattggcaagatgataaccagaagtttgcttatttttggaattctgtgcctagtctatagtcggtgcttaaaagtatttgttgaatgaacactgattctagcaggaatcagatgtataccatgtactgaaaactccataaataaaagatgctataaaacttctgaatgataagccagctacctacgtggccttggtttccctaaaaggattgactatagtggccatatctgggtcatgaaagagccttttctctcttttccttttctgtcattcagctaatcctcctgacttctgattgtcccactttattatttctctatgattgagcaggtcaactgccctcttaaaactctcgacagcctgttcgttttagcagtgactgccttctcctggaatcctggcaattagaagcactcttgggaggccgcgcgtggtggctcacacctgtaatcccagcactttgggaggccgaggtgggcggattgcccaaggtcaggagtttgagaccagtctggccaacctggtgacaccccgtctctactaaaaatacaaaaaaattagccaggcgtggtggcatgcacctgtaatcccagctacttgggaggttgaggcaggggaattgcttgaaccagggaggtggaggttgcagtgagccaagatcgcaccactgcactccagcctgggcaacagagtgagactctgtctcaaagaaaaaaaagaaaaagaaacactcttggcagttgtattctttattcttccatctactgtctgtctcccctttaagagtaatgatattggacacttgttaagcacctccccatgccaagcaccatgctgaatgctttattcacacaataaaggtgaataaatgcatggagaagtcactcagggctgggcgtggtggctcacacctgtaattccaacaatttgggaggccaaggcgaaaggatcgctagaggccaggagttcgagaccagcctgggcaacatagcaagatccccatctctaaataaataaaatataaaaagagaagtcagggttacatggctaataaggggtagaaaagggattcagggcccaaactcctaaccatttcttttttatccacctctgtaatgtcccttccaaatggttgcttagctgctattgtattccatcacttggctgcccatttattttagatagatctagttattaggaaattcatgttgaaccaaaacctattaccaggaacaaatgagccttagatttgcttgaaataccccaccaacatggttgctttcttctaggcatgttacaatttactcatgtcccagtggtgtaaaggtggcactttgaactgggcagaatattctgttcatggtcataccagcaatgctggactgttacttcctacacatcacagaattagctcttcttgtagctataacacacttctaactcacatagagcaaatagatcagtttttttaacacttgcaactgctattaacattcatctttttcatatttttacagttggctttggctttttgcagtcacatactctgccactgagctatacccgctgtctttggctttttgaaccagagggtaaaatgatttgtcattcatgactgtcctgtaactgacattacacattgccgggttttataaggaagaacaaaggaagacctcttttttttctttttattattattatttcttttgagacagggtcttgctctgttgcccaggctggagtgcagtggcgtgatcagggcttaacggcagcctcaccctcaaggccctcctgggctcaagtgatcctcctacctcagcctcccaagtagctgggaccacaggagtgaaccaccacacctgactaatttttgcattttttgtagataaggggtttcaccatgttgcctaggctggtctcaaactcttgggctcaagtgatcatcctacctcggcctcgcaaaatgttgggataatatatgtgaactaccacgtccagccagaccactgtcaattgtatggtctgggaaggcttcaccaaggaagtgttagtttaggcgtgaggaatgatggagtaggggggagaagggctttccaggtagaaggaagcatgagtaaaggctctaaggcatgaacatgttggctgggtgcagtggctcacacctgtaatcctagcactttgggaggcctaagcgggcagatcacttgaggttaggagttcaaaaccagcctggccaacgtggtgaaaccatgtctctactaaaaatacaaaaaaaatagctgggagtggtggcgggcgcctgtaatcccagctacttgggaggctgaggcgggagaatcacttgaacttgggaggcagaggttgcagtgagccgagatcaccccactgcactccagcctgggcgatagagtgagactctgtctcaaaaaaaaaaaaaaagtgcttagtgtgctcaaggacctgcaaggaggcaagtgtgtgtagccagggtgtagtgaatgagggggaaagctgcacaggatgacactgggaaggctgaaacactagaggcgttcccattacatgaataagcaacgacaaacttacaagcattttaaaggaaaagtgcagggaatactaatgtgatgatgatgctggctgttgtgtattgcccgctttctgtgtgctacgcacatttaaagtgattcacatgacttatctccatcctcaatacaacctgaggagaatgacactgttgttatccccattttaatagatgaagaaactgaggcacagagttgtttagaaattgagatcatgctagtagtggtagattaaagattctccacccaggcagcccaactccagagcccttcacctctatcctgtacacctaatagagggtcctgaactagtcagagagcttgggaaagctttggttgctggaagaccgctaagacaagcagcacccctatcctaatgctcttatataatacagggagacatcctcactgggccaggcctgattcttcaggggctaactctgcaactctgagtagaggagagcaggcagcagacagccagaattggccgcctcagttcattgttacaactgtcaaccacaatgtggctgctttaaagataacaaatacggagctgtgtgtggtgtcatgcccctgtgttcttagctactcaggaggctgaggcaggaggaccacttgcgcccaggagttcgagtccagcctgggcaacatagtgagaccccatctctaaaaataagaatgcctaggctaggcacagtggctcatgcctataatcccagcactttgggaggccgaggcaggcagatcacttgaggtcaggagttcatgaccagcctggccaacatgttgaaaccccatctctactaaaaatacaaaaattagctgggcatggtggggggcacctgtagtcccagctgctagggaggctgagacaggagaatcacttgaacctgaaaggtggaggttgcagtgagcggagatcgtgccactgcagtccagcctgggtgacagggcaagactccgtctccaaaaaaaaattaaaaatagaaatacattttaaaacccagatacttgtagcatatataagggacaattgcagtttggaaggtacttccacatgtattatataattttattttttaaaatgaatctcatttggttgtcatgaaatttggtaagatagataaggcagggaatattagccttgctttacagatgaggcaacaggcttagagaggtaccaaggtcaccccactagtgagtagtagagagactttgtttttccaatccagtacccctgcctcccctcctcacccatttggttctaatggtgtttccttcatgtggccaggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccaggtgggaagctaggaggattggagctgcacgtccagtcagcgatctccttaccttgaccacttccttttctactcccaagaggagtgctgcagaggggcttccagaagagagggtagctacccactttgctaacagtgagcagggtggtccgcaccattagccacagttccggcagtatgtcatacttcctgagggagggctgacatgtaccacatcctgtcagcttgcaaaccagtggtaatctttgcacttccttgttctgaacccatgggctcagaccttcctttgccctcagccccttcccatttgctaggagagccctagggcagctgggatgtgcttgtggcctcgttggtgagcatggtaatcctgagcccacaagctgttacccccctacccctccacagatgcagctggaaacagagaaggagagagtatccctcctggagacactgctgcagacgcagaaggagctagcagatgccagccaacaactggaacgactgaggcaggacatgaaagtccagaaattaaaggagcaggtatggagggtggtctcgggagtagggaagaaaggggcactcatttacccattcgaccatgaagggttcttgggcacttcttatgtgccaggccctgtgctaggtgctgacatatgacaagtacataaaggtatggcacaggctgggcagggtagatcacgcctgtaatcccagcactttggcaggccaaggtgggtggatcacctaaggtcaggagttaaagaccaacctgagcaacatggtgaaacccatctctactaaaaatacaaaaattagccgggcatggtggcaggcccctgtaatcccagcacattgggaggctgaggcggacagatcagttgaggtcaggagttcgagactagcctggccaacatggtgaaacctcatctctacaaaaatacaaaaattagctgtgtgtggtggcatttgcctgtaatcccagctgcttgggaggctgaagcaggagaatagcttgagcccaggaggcggaggttgcagtgagccgaggtcacgccactgcattccagccttggtgatagagcgagtctcaaaaaaaaaaaaaaaaaaaaaaaaggtgtggcacagcagtcagcataacagacattgcccctgctctcaaggaacttacattcctgtggcagaaatggatgacaaatgagcagacacaaagtaaatgagattattacagtttgtgataagtgctgtaaaggaaatagaatgatacaactgagagtgagtcaaaggaggttcactttgcacttagtggtcagggaaggcctcactgagaaagtaacatctgagctgagacttgaaggttagaaagaaaccagctccgtgatacaacataggtgaaccttgaaaacatcaggttaagtggaagagccatatattttatatgatatgcttccatttatatgaaacaccaagaataggcaactctatagaggcagaaaacagatttatggtggggaatggggtggggaatggggattgactgtgaatgggcacggggtttattttgggattgatggaaatgttctaagattgattgcgatgatagttgcacaactctgtgaatatcctaaaacccactacactgtatacgttaaatgagtgaattgtatggtatatgagttatatctcaagccatttgaaaaaaaaaatgcctgccatgtgaagaacactttaggcagaggaaacacctgtcgcaagggccctgggacacagaagagggcttgggaagttcaaggacaaaaaggaggcagtgtggctccagcttgataaactcaggggcgagtggagcggtagccagaagccctgtgtcagccattgtaggagcttggattttgttctaagagcaatgggaaactgttgggtggtatgtatgtatgtatttgtttgagactgagtctcgctctgtcacccaggctagagtgcggtggcactatctcagctcactgcaaccttcgcctcccaggttcaagcaattcttgtgcctcagcttcccaagtagctgggattacaggtgcccgccaccatgcttggctaatttttgtatttttagtggagaaagggtttcaccatgttggccagggtcgtctcaaacttctgacctcaagtgatccacccaccttggtttccctaagtgttgggatgataggcgtgagccaccgcgcctgggcagttggatggtatttaaaaagcaggggtgggatatgatttatttatatatacgtatacatatgtatatacatatatgtatatgtattctctactctcctgagtagagaatagtgtgtgtgtgtttttaggggatcgtggcatcaagtggaagtagggatatggttaggagactgtttccatggtctaggtgagagactattaccaattcatggactctgaccaagaaacctgggtgagccagtgcactttgtgagggaggagagggactaggaagtgagaaggtgaggtggaaacaatgtggattgctggctcctgcctcagcttttgccaccccaccaaaaaaaccagtatttctatgacacagatttcctctactcaatgatttcttatccctcttcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtcccctcctcctccccaccaagtcccatggtccttccccaacacagccaggctttcccacttcctcttgcaggacagggagaaccttggccctgctgcctggtttgggagggtagatgggtgggccacagtactgagtggaaaattagagggtgctcagagttgagcatgtgcctggcagagccctgggatagtaatctctttctctgtaatggtcacagagtttttgttttccctggctgtctcagtttcaattgttctttccgtccttgccaaaaatctaatatttttacatactaggttgcttctcctcagaatcctatatcaaatgatgttctgacttttcatttttaaaaaagcaatcacaatacatgttttgcctttgggagtagttatagtcagcctttttttccttctttttggtgggggagacaggatttcactatgtcgcccgggctgaagtgcagatcataactcactgcagtcttgacttcccaagctcaagcaattctcccacctcagccccctgagtagctgggactacagatgtgtgccatcacactggctaatttttaaatttttatagagacagggtctcactatgttgcccagactgatctcgaactcctggtctcaagcagtctgctcgccttggcctcccaaagtgttgagattacaggtgtgagccaccgcacccagcccagccaagatttttatttgtgcctgcctctatgcagcatatgtgaggctgggaggcagatgaccaggccgaattgtattgaggaagggggtggttaagaacagtgtgtaggaattggtagaatcgccagagcattggaaatggccactgactatggtaaacctcgaaggaccctgaagccctaggtgaggagcatcttcccaccggccccctgccctgccatcttggtcttcatgcccttaattttccaggtggaggacttgaagtctcagctggtggcccaggatgactcccagaggctggtggagcaggaggttcaggagaagctgagagagacccaggagtataaccgaattcagaaggagctggagagagagaaagccaggtaggctagataggccatggaggtggcttttgtctatctggctgccatggtcactgtgatattgacagttgtttgctcaggccaccttgcctttcatgtctgcaactctgggatgtacatgtagccatgtggagaggacatggttcctgtcttcaaagcttgaacttcatttatttagtaaatatttcgtgaacgcctgttatgcaccaggcaccatgcttggggatacagtgataaacaagactgtatggtccctgccccagtagaatttatagttttgtggggaagacattaatcaaataataactcaaattattacaggttatgacacatggaggaaacagggtgagagagagaagagactttagaaccattgttagggaaggcctttctcaggaagttgcatttaaactgagcactcagcatgaagtggagctacccatgtaaaagggtgagggggagttctattccgtaagaggagaaataatatgcaaaggccgtgaggcagataaaagtttacagtgttaactgaaagagtggttggagcctgattggattgtaattggagcctggtgaatgaggagagtggcatgagctgggcaggtccacagcattcaagatttggtaggccacagcaaggagttcgtagtttgagtttcataggaaacctctggagaattttaagcagggaaattgatacaatccaacttatgatgtatttgaagggattgtaatgccatgagacatcaggagtgaaagaagaccattcagagtgaagagcagcttgtattcttagtgctgtgggaatttgagaaggggatgggctgggtgctgtgtcccacgactgtaatcccagcactttgggaggctgaggtgggcagatcacttgaggtcaggaattcaagaccagcctggccaacatgtctactaaaaatacaaaaaaaaattagctgggcatggtggtgggtgcctgtaatgccagctacttggaaggctgaggcaggagaattgcttgaaccaggaggtggaggttgcagtgagctgagatcacaccactgcactccagcctcggtgacagaacgagactccatctcaaaaaaagcaaaaaacaacaaaaaaaagacacagtttgagaagggacacattattttggtggtgaatctagaggcaggaagacaagttaggctggtacagttgtcctgatgagagatcctaaagctaaaccaaggtagggtagtggggaagaggaggagagaagagaagaggtttaaaggatgttaagggagttagaatcaattgtatataattatagattggatgtaggtaggttgaagggagaactctggagtagtcaaggttctacgttaggacactgtgtggatggaagtgccattcactgagctagggaacatagtaggagatgattgggtggacaggggaggagaggaaagggatggggaagatttggacatgttgaacgtgaggtactaatataaggtatgtgtgaaatttgccagagaagaataaggttgatagctaggcatggtggcgcatgcctgcaatcccagctactctggaggctgaggcacgagaatcatttgaacccgggaggcagaggctgcagtgagccgagatcgtgccactgtaccccagcctgggtaacagagcaagactctgtctcaataaaaaaaaaacacaaaaaaacctgtgaggttgaaatggggcatcatctgcaggaagtacctaggagcacttattatagtaagtgctcaataaatgatagcttttattgttacatcataatcattatcattactatttctattttgattattaatgctatgtttagaatactcagatgagaaggtaatttttcattccctaagagaatggcccagcactctgacccctctctttttagcctgactctgtcactgatggaaaaggaacagagactccttgttttacaagaagctgactctattcgacaacaagagctgagtgccctgcgccaggacatgcaggaggcccagggagaacagaaagagctcagtgctcaggtacttcccactctggttatgagctctgcatccctggcagaagcctgattctgaagcggtggattgattgctctgagtcctctcatggagaggacccatctatttttcctgattacaggataggctggtgcctcaacacccctacaggagggggaagccaggactagacaaggcgggggcttgggaatctgacccagagatggacatggctcctgtgggaaacctgacagcccacagcaaagtgcacacgggtgtagcccatgcaggcctggttccagcacaccggcttcaaagtatgctgggtctggttggcaagatgtagcagggagaatgagcaaccagaaatactccagatcaggcaggcagcagcaagacttccagggactcagtctgcccccatcagaaccccagatattgtatacagagaaaagatggaactaggagggaaggaatggggtgtaagagccagatggtggcttgcaggggttaagggcacacaggtttggctgttcaatggtcttgagtttgaatgtaagctttctaattgtgtgaacgtcagcttcttcatccataaaacaagggtgaacaattcttgttcctaattcctataaccattataggaatatataaagtgtcaggaacacaataagcattcaatacatggtagctatgttattgtgactggtcttactaggcgcagcgtcgaggtttcagggcagagttctggtcatagcaaggagccagcatatctgcccaggaagccagggctgaagcccattagcatagcagcctgggcccatgtgttcagtagtcggcaggcagccaggtgttagatctagggtaacactcatttcagagcccctctacctgcctgagagctgagctgaaatcctcccagccctgatcagagtttgtacaaggattgagtggggtctggcctgggaaggcctgaggagagggtatccgcttcctgcttatattatgtaaaattcttccttgacagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccaggtgagacagcctccccagaactaggtcctttgggccaaagccaggcctggctcccaggggaaagggagaggaatgctatttgttagaccatattgcttcagggttaagattacatacttgggaattaattctgagtttaagccccagctctaccatttgctagctatgtgtccttgggcaagtcacctgtcctctctgagcttgattttcctcaactacaaaatgaggatgttaaaagtatttaccttatagtttcaccaaggagttatgaggttgcagatgtgaatcacttacacggttcctggcacttattaagtgcgtaataagtgatagctcgcattaatctagcacccaccatagtgcctggcccatacttatggagaaaatatgtgatgagtgaactgctgagaaaggggttctttgcggagaggagggaccagttggaaggacagggctgtgtctggagaggtctggctgtttcttttcatagtggcagccaggtaaggaggttttcctcattttttcagaccagaatggagctaggagcctctttaagagagggcccctgctgactgctctctccgctgaggcagtagcatctgccctccacaagcttcatcaagacctgtggaagactcaacagacccgggtatgtttctctgctcccctttcccgaactctttacatccctggaaaagcatgaggcaaaggggtgtgaagcagtttgacctgttttattcctgagatcaagttgggatgagtttcacctctatcacttaccacctggcaaccacaaatgaagcatttgaagttcctgggccttgttttcccttgcagagtagggcagatagtgcctgctcagggttttgaggattagatgagagaggatcttgaatgagccctgtaaaccaaaaaaccctgggtaggccaggcacggtggctcatgcctgtaatcccagtgctttgggaggctgagacaggtggatcacctgaggtcaggagttcaaaatcagcctggccaacatggtgaaaccccatctctactaaaaatacaaaaattagccagaggtggcggtgggcacctgtaatcccagctactcaggaggctgaggcaggagaatcacttgaacctgggaggtggaggttgcagtgagccaagattgtgccattgcactccaggttgaacgacaaaagtgaaactccatctcaaacaaacacaaaaaaaccctgggcagatgtatggcattgttttccatcatcttccactcagctatgaattaattcttggtacccaggcttccaagagaaaccctagaaatcagtgaccactgagatttgaggttggcatttataggcatgttctaggcctaggtctgaaagagctcataaattccacctcacagtgaacctatcagtcaatacaaattgagtgtcatccatatgtcagccactctgggctgggtatacaaaaaggagaaagacctggtctctgcctaaagaaggcttgtgacatggtggaggaaccaaactgcattctactggaaagcagaactgagagaattaattggatcaataacagacgcaagtgatgcactgttggaactaggaggagggggcaattcatcctgatttgggaagggtcagaaggaaagaagagatgacctttgggctgagctttgaagtaggagtgttgagagggaagtggtgacccctgggctaactttgagcaggagctctgtttcaaaagacatagataggtcagaaggggatggattctcacactccatccaagtggagcagagcctgtcatcacttcaggaagctaaatacacatgtgtttaaaggaagtaacccggcaatctgggagtaggtccacaatggcggcccaccacagaagctgagaatgaggagagagcttgagccctgcattgttttgtggaagatgaggaactcacgtttagccatgcccttcctttcccaggatgttctgagggatcaggtccagaaactggaagagcgtctaactgatactgaggctgagaagagccaggtccacacagagttgcaggatctgcagagacagctctcccagaatcaggaaggtgagaagctcaagacaggcagggagattgagagggagaagggataggtggggagcccagaagtggcaggcacaggcctagcagccactctgtttattttattttatttttgagacgacatctcactctgtcactcaggtttgagtacaatgtcacgacttcggctcgctgcaacctatgtcttccgagcagctaggattataggcatgcgccaccacgcctggctaatttttttggatttttaataaagacggggtttcaccatgttcaccaaccagcggagccaccggggtctctaggagctcctgcacaattataggattgggggctagaagggacctccagtgtcatctggctcaaccctgtctggaattgagggccaaggctctctgtgatgaggatgaggacatattgggatgattaccaggcagcgctggggctggcagcagcagggagtgcttgaactcctggcctcaagtgatccgcctgcctcgacctcccaaagtgctaggattacaggcgtgagccactgcgcccagctgcactgcattatttacccagaaatgtgaggtgagatctagatgcacttccaaaggggtgctgaccaccttgaactattttttcagctttgcttggcctttgaggcccatcctggaagaagagattaggaggaacagatttgatgaactgaaagaaggaaatggctgggcttccattttctgtctctgtagatttaaaaattaaaaaaattggagacccagggccgggactgtaagaacattataaaactgcatcttttgtcatccatgttacttatttttatcatcttcaactgtgtcctccaagttagcctttggtagctgagggattatgagcttatttgggagaaagcaaagagaggggatctggggaggatatatccatgtgccagccaaggactagaaagtgtcatgactccttacaaaggacaggagaggaagggtcttgaagctcaagtttctactgtaaaagagaagagttagccgggtgtggtggtgggcacctgtaatcccaactactcgggaggctgaggcaggggaatcgcttgaacccgggaggtggaggttgcagtgagccgagattgtgccactgcattccagcctgggtgacagagcaagactccatctcaaaaaaagaaaaaaagagaagaggacaccttgggtctgggccttttttgaggccgtttgagggttccctgagagccacaaaaataatgggattccaacgcctgttgcagaaatggtgggcaaccagcagagccacccgggtctctaggagctcctgcacaattataggactgggggctagaaggaacctccagtgtcatctggctcaaccctgtctggaattgagggccaaggctctctgtgatgaggatgaggacatattgggatgattaccaggcagtgctggggctggcagcagcagggagtgctgccaggcaaatagaagcagctggcatctgccagctcttgatgtccttgatatctctaggacactggatataattttctccttcttggccttccttccctttgaatctgttccccatcctccatctgcctctatatccctctatatcccaaacatgggtcttactccactacctctcctctcctctcctcttctcaaagagaaatccaagtgggaaggaaagcagaactccctagaatctgagctgatggaactacatgaaactatggcatccttacagagtcgcctgcggagagcagagctacagcgaatggaagcccaggtaaagtggtactggtttcagggaggggtttgcctcaggagtagtcccttgggcccaccttggcctgtggtcctgtgtcccacttccttcagcaagtctgtcagttcctctggctgtctccatgtccctgggggccattattcaggttccaatgaatcctccttcaattgctttttctgaattgaggttgatatttttgccccttgtcctgaaggaccagcgtctcccctgggcatagcagagtcctggaaggtggtagggatgcccttttacagtatcagcttaagtggaatataccaccactttttttttgcccaagtccttatcactgctagtgccacaaaataagaaagagaagggtcggtgttggggtgacagtagcagggaagtgtagtctaaagtggcttttcatcttgtcttctagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggtaagtcactccatggggagtaagggccaggggacacacccctgtctggctgagctcagggactgcccaccaccctgggccctgtggcacctcaggggtatgagaaagctgagatcatgagcacctcaacatcggtgggattcaggctactgtgctagtcgggagatacagagaggataagacccccacagtccctgccctcacagagttcacagtctagtgggtaaacaacgataatgcagtgtggttggtgcctaatgggggaagtttagtatgccccaggcatgctggagggatgcccaccctttcctgggagtgggtcctgaaaggctttctggtaaaagtggtgtttaagattagacctgggccaggcacggtggctcacgccggtaatcccagcactttgggaagccgaggcgggcagatcacttgaggtcaggagttcgagaccagtctggccaacatggtgaaaccccgtctctactaaaaatacaaaaattagccaggtatgctggcatgtgcctgtgatcccagctacttgggagtctgaggcaggagaattgcttgaactcaggaggcggaggttgcagtgagccgagatcgcaccattgcactcgagcctgggcaaagaaacgagactccatctcaaaaaaaaaaaaaaaaaaaatagacgtgaagggaccagtaaggaactagccaagcacaggttgaggaggagcattcacgggaagaggaaaagagggcgagaacaagtgtagtatctgtgtagatggttcaggttgcatgggacagagggaggatttgggaagagaccggaagacagcaggggccacacctgtcagggcttacaagtcatgctgaggacctgggtggtgggaagcagatgaagtttttgcagcaggggagtgatgtgatcagacatacagctcacaaagattgctcaggctgccgtgtggagcaacagcatgtctggagagacccactgggaggctgtactgggaagtccaggggagagcttgtgccctaagatggaaagtgtgaatggagacatgtgggtgggtctgagaggtaggacttgattggctaagaggtgggaggaataaagagagggcagaaagaagtcaaagatgacactcaggttcctgttcatgaagatgaagagaagcaggtgtgagaaagaggagtggaatgaatgatgaggtcagtttggaaatggagggaggagcctgttggcaggtcagtaaaatgatctgaagctgaaggatggagttgaagccagagacactttggagtcatcagcagttagaacaaatgggtttcttgtaggcagaatgttgagtgagagaggaagtgggcttaggagaggacttcagggtgtattatttaacctcaaggtcaagcaccgtgtcttagtcacctttgtacccccggtactgagcacaagacctgcagagagcaggcaaacaggaaagccaagttggctcaagagagagaggcatcatctctttttccaaaagacgcccagtccaattttccagggaaatagactctacatcctggtcccttgactgggccccagagaaccccagacacacagtcccccagagagttcattctgggaactcacaaagctctgctcttggtgaagggcaatatgaggagaaggaggtccatctgtgaactccaaagttcacagggtttgaaatacagtagtgcggcttatcagctgtgtaaccccgggtgaatgccttcactctgatcttcaatttctcatcagtaatataggcattggtggtatgacatggcatgatatgtatgaattgcttaggaagaaagcactaagtggacctcctttcctatgttcaggcccattcttacaggcacagcaaaagtaagttatgtaattgggcaggagggcacttcccacccatactcttgggttactgagcagtattcactcaataacataactctggtcagagtcacttcacccactgccacctccaaacacacagggtgagactcttgtctcaaaaaaacaaactcataaatggcaggactggaatgaggtctgagtcatctgcctctagagcgcaggctttctgtcaccaagctcttcctctctcccaggcaacccacatccacctgcgtacacttgttttctcttgttcatctcttcttgactgttatcatttatgaaccacagggcacctagaaagtatctagcatgaggcttccccatttatccaaagggacttaacctaaggacttgatccatgtttcatggtgcatgtagtcgttttataaatgaggaaattggggtttggggagagcttgtgctttgaccagagtcatatagccactgagtggctatatgggccactgggtacgccacagggcacccagccctgtgtgactcgagagtccatgctgttcccacagcacatcagtgctctgagtcattgctcagccttctaggagatgtgaagtgagctgggggctctgatcctagcttccttgctagctcaccgcatatccttgagaagagcccctctgctcctttgttttacctatctgtaaaatgaaggttctgtactagaatgactcagagcctctaggaaaaataagacaaaagcctgaggagaacattgaaccgctgtttgtgtggaggatgggttggtctggatatgaggttggcaaggtgtgattttgctccatacctccgtaccctaggatgaactggagctcaccagacgggctctggagaaggagcggctacacagcccaggtgcaaccagcacagcagaactggggtccagaggggagcagggtgtgcagctgggagaggtgagctgggggctctgggggaacaggtgacccagcagggagctcctgtccaggggtttgtccccttcccttgggaactgggttcctgaagcttaaacctgccagattggtctgtgtgtcctctgtctgttccctacctgtcttaggggctgcccaggtgagattcacaggtctttcccacaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtgacccctcttcttgtccagtgggcatgcatctccacttctcgtgtggtccctagagcataggctcagtaaattacagcctgtgggccaaatccagcctgctgcctgtttctgaaaattaagtttgtttttttttttcccgagacagagtcttgctctgtctcctagagctggagtggaatggtacgatctccgctcactgcaacctccacctcccgggttcaagcaatcctcctgccccagcctcctgaatagctgggattacaggcatgcaccaccatgcctggctaattgttgtatttttagtagagatggtgtttcactatgttggccaggctggtcttgaactcctgaccttgtgatccgcctgcctcagctttccaaagtgctgggattacaggtgtgagccaccacgcccagccctgaaaattaagttttattggaatacagccatgcattgtttatggctgcttccctgctatgccccacaaagcctacagtacttactgcaggagaactttgctggcctttgctccagaggtctgagaggctggccctgcctcttctgcttcaggagcacttctttgcactgaggcctgccctagctgtgccttcctcagccaggagttctcttcccatggttactgtcccctcatatacctgcacaggcactggccacctctggagaaaggcagctctgctccaaccacagagccaagccgagccctgatttcttatttgcaccttggcaggtggagcgagaacggaggaagctgaagagggaggccatgcgtgcggcccaggcagggtccctagagatcagcaaggccacggcttcttcacccacacagcaggtttactcattttcctcagctgcagccttagagagcccaaccccagccaccagaaactcagccctcctcattgcatatcccgggccaacagcacttcagctagtccagagagcccctcctgactgcattctgccctgctcggcacagctcagtctgtccctgccctgagaaggaggcccaacattggggtgggggttggggtggctagtggccctgccttctgagggacttagatctgtgtactcccagaccagtgccacagactggcccgggagtggggctcatggggctctgcttaggatccctggtgtatgggggttgtgtggtgcttgccagctcctgaggagcctaggagcttgatcacagcttgatctcttagacctttttacaatgttgagtttataggcttagggtccatggtctttcctggagccagtgtcccttttttgggtaagaggcttggggaagactccccaaactactcgtctaggtgaggtatccctgccaacagacacaggcttgcagcctgacagggaggcgctgtttatggtggctgagcactagatctccatcccttgtcctttattgaaagttctcaagggcaggcaccgtgtcttcctctctgcatccttagctcacagcccagggctagcacaaagcagatacatggtgtacttctgttaaattaaaacatgcctcagagaagcaaatgccatccaggccttttggatgttttgtgtcaggtctccatggcgttgcccattatgctggtgtggggcctctccttgctgcagggcctgctgccccatagacgtccagtctgagttcagatgcttctggcccatagcccttgcccaggcccctaagattgtgatgaggttctgcaaggaaacttgcagaaaccccagagtgggaaggcctatgccaacaagagtgctgtttgtcttccttaggatgggagaggacagaagaactcagatgccaagtgtgtggctgaactgcagaaagaggtatgttctggattttctaagcccatattccctcccttgcactcaggccctttgtgcacctccagcagggagaggggaagttcctcccttcagagaacttcagtctccatgggaggcaaaaatagtcccagtcccaaccccatctctcatatgcctagggtgggagtggggaagaaagcatgatcctggcccccgacttccaaatccatacttagaaagggaaaggagtaggaagagggctgaggagcaggcagaagattctaggaggacaggtgggagcaagggaagccatcctggcctccctgccctcagaggtgccctcgcagccaagactgttgccagtgccccagacagaggagccaggcaccagcacaagctccaggccacacagctcagcacaagctccaggccacacagctcagctcaagccgccactcgcagagaagtgacttgaagagccttcctgcctcttaggcctcaactaaaagtccactctccctttcaagttgcaggaatcataagtgttacctttttatttctgagcctatttcagaaatcagtagtcactactggcagggcctgactctgtagctagacctaagctattactttgaattctattaaactcagaatgtttttctattttattaaaaagtcaaagcaggtgcagtagctcacacctgaaatcccagcactttcggaggccaaggtgggcggatcgcttgaggtcaggagtttgaaaccagcctggccaacatgacgaaaccctgtctgtactaaaaatacaaaaattagctggacgtggtggtgcacacctgtaatcgtagctactcaggaggctgacacacaggaatcacttgaacccgatggggtggaggttgcagtaagccaaaattgcatcactgcactctagcctgggcaacagagcaagactctgtctcaaaaaaaaaagtcagatagtggttatacttgagtatatattgttatcagcctcatcaaaatgtacatttaaaactgggcatttttcacatgtaaattatctttcagtgaagttgatgaatagctttgtggttttcaagcgcgctatttgagtcacatgtgcagccaggattgagaatcactggattctagaattcctaagggcccttcctctaaactctctacagcctgtttctgagattcgtgtatgtggtagagttgattcagatgctcagccaacgagcttcagagaacacagagcaggaagagctgggacaacttcagggccctcagctgctctcccttttttttttttttcctgcccaccaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcattttctgctgctgtctccacttgtgcagctgggtggcagcaccacatcaagggagtttatctgggaagaacttgccaaagattcctgttgaggtagcatgcatttattgtacaccatgcactgtgatagggaagggttacagagaacacacaagacaaagcccctgtccacagacagcctacagtccagttgatgagaacaggctaacactcatttatgagtcagaggcaattctgtgtactgactagaagaactgtagaaattccaggggctgaggaagggaggcacgaactggcccttgaaagatggagtggggttggaggtgttgccaagcacacagtgagaagactggtctgactgtggcagggggttggggctgagcttgggtgggttgagcggggagattttggagggttaaaagaagttctggggcctcaaaaacacagcgttgacctttagctaaagtcagagtctctgagttcagaagctccacatggcctcattcctcttctactctgggtgaatgtccttgagatgtcccttcctgggcatatcagctggaactgatctggtcgcctgtagtccaaccatgtgtcaagccaatcagaaggatggactatggcggaacttctcacccatggactggtcctagtggaggctggacagaacccagctcacaggcttaagacctattgctggcaacctcctcaaagcctaaaaattgtttaatttttttaagagacagggttttgtcctgtcttccaagctggagtgcagtggcacaatcacatcttactgcagcctgaaactcctgggctcaagtgatcctcccacctcaacctctcaaagtgctgggattaccggtgtgagccaccatgcccaaccagaacagttttccttaaagaagcaggccattaccttcctctggcactcccaccataatctggaattcctctttactaagcctggggatggaactgagacctagccaagaatctgggaggggtaagagcagcacccactcacccagacctcctaatttggggctcagccccattatgtctcattgcaccacacagagtggaaatggggctgttcacagcgactagagctttgttccagaaacctacacatgcagctcagcaacagatgcttagtgaaaacttctgaaaccccagaaacagatctggggccccagaaatgctgtcctggtccctatttccagtcagattccctgtagcttaaaatccttacctggcttttaggccatttatttctttttcctttttttttttttgagacagagttttgctcttgttgcccaggctggagtgcagtgacgtaatctcggctcaccagtggcaacatccacctcctgggttcaagcaattctcctgcctcggcctcctgtgtagctgggattatagacacgtgccaccatgcccggctaattttgtatttttagtagagacagggtttctccatgttgatcaggctggtctcgaactcccgacctcaggtgatccacccacctcggcctcccaaaatgttgggattacgggcatgagccaccgcgcccggccctttaggccatttttatgctaggagttgtcagagacaagacttctcttggttgttcacttgttacatcctccagccctggttctcaggctcgggctgacagagggtccctgttttttaccttagagtttcttctcagcatcattttctgtaggtcatgagccagggccttaggccccacataccttctgggcctcagagaggttccagcagctgaaagacatcttagaggctgccaagcagggtctttattcaggactagactaatctgtatttgctcttctctttccatccaaccctcaagagccccccagctccattatagacctcggcctagggtctcccctccccaccagatattcagagcagggctggccttcagttcaagtgtagactgtgctcttgccctcacactcgagcttgtggatgatcttccactccggctttctaaagtacactttccttgcccagtagcaggattgcctctgtggagtgtcccaccaataatggtgacaactgctgttttcatcagctccagacccaaagagacctgaagtggggaagtgtgaaggaaggaatatgtgtcatccaggggggacccaactttgcctaagggcatgaggccggagcctcctttcctgaccttgtcacatgtggcagggtataaccagaatggtgaatccagcagacgggaggagtccctggcagtccagccagttctcgtggatgtacttgaggaaggtgcaattggccaccagaacatgcaggagtagaggttagagctcagccacagagattatcttcttgcagaaaacttttttcccccttcctaatcttgtctgctttgatagaagctggtactggctggaaaggcctgaaagcaggaggggacaagagtcgtcagaggctgggcaatgttcttgtttccggggagtgctgaggtccggcgggtgctgcccctgttctctcaaggatcccacgtgctttgtgtgttagagcagtgaccatcacctcccaacccaaggacctttgctgctctgcttcccacatgggactgccagcaccctgaaggcagaaaaactgaatgtacccgttaaaggaggagaagctggtggtgtatgttgagataaggagggtggggagtgtacagttacaggctgcacagggagggcaagatcaatgttgacaccaaagtgccaaaggctgtctgcgccaggtctggggcccccactggtcataccgcctgataaaaccattgcagtccacactaggtctggaggcttcgacacccacagcatgtgggtgttctcatgcaggccatgagtattcggggtgctttaagtgcaggggagttctgttgtccacgttattcttaaagcccagaataggccctgttttattctacagagataggaaggcactggggctcacagagtggtgctgcttcccaccctcacccttctgcccccacctgagcacagtgtggtgctcagtgatggttatcctatattccaaatacgcatggcccaggactggcagagtcggagctcggggtctagctgtgacctggggatcggttggagtagcttcttgaccagccggaattgggttaggtgtcctagcattggtgcctatggagaagaacacagactgtttatcactcacccctggttccagtaccaaggaaaggctggagccattgcaactggaggcccagcggaggaagggatcaagaagaggatgcagcccagagcccaggaccgagcatccaccggcctctggagatggcgtggtctccagttgcatcggggcttcagggcccatctgaagtgctgatcaaaccaggcagacacaccatgctggtgaaggcaggctttgtagatgcggggctgaattgagcagccacagaacctctgcagctctggggccagtggcagaacttctagaagtacctgtggggtgggaaaccccagccacaaaagcagtgagctgacttccaggcctgaggctttgcctgcaggcctcatctcagcccatgggacagattcctggtttttttagtttggccttggggtagatgataccttcagctgtccaccctgcaatacctcacctcctgccttctgacccagtactctgcagagcgggggaatggggccaggggacaggggcagggaagaggaagaagcaagagctgccagtgtgctccaaaccaagagagccctccacatgattctgggcacagctgaggaggagtgcaagctcaactctgctcaccacacttaagaagcaggcaagggaggatgaagggcaaaaacatggggtcctgaggcccttttactccctctaccctgctggaggtgaggatgagaggtgagacttcgttggactgtgctcctggccagttgatctcacccaactcattacatcagtagcctggtcacagggtggacactctgacctcttcttagcctttcattggcaatactaccagctctatatatgcccttatagggcctgaaccttggctcaggtggatgggcttggaggtaaaataattgaatgggtcaggggtaggaggagagatgagtctctgccaaggctgtgtgatgtgtcatctgagagagtgggtaacccctattcccagcacatggccatttatttagagccagggagggggacgagaattcatattcaaatgtgattctttcttaattactaccagttgttcaggtgagggaatcagggaaggccagattaataatccacacattgcccttgcacctcctgtcttggtttcctatcaaaacctctcccgtatctatgaacattccagccctgcaggtcagattgctggccaggagtagtctcacattctagctgactgatggcctcggcttctgctgttgtatgtggtttgatgattcatgctggagcctttggctataactctcttccctgtataagggccatctgaagtttgtctgcctgactccattacctggtgaatgagattggctagctgctgctcctgccccagctattcagtcatttggcaaatactcatttaaacaaagctccacagggagctctgagaaggagctcacctctaggcacacagaacctggacacagatgaaagtttgcagaatgacccagttgtgcagaagagacccactggctgctctcagtgaggccagggagagtcaaacagagcatcttggacaaagagagggcttgaaggccctttcaaagtgtcaagccagttggatgcacgggttgtgtggagtccaggggtacatccagaagcaatggcaggtgttatccattcattcaggttagacctctgagcagacggcagaaacgtcagccacaggtgagcataagctcaaacccccccattgaaggctacattcttgtcccacagggcagagcacatggcaagtggcatgctgactcagacaccgggcactgagaaaagtgggaagccatggtcacagactctacattcccctctcctgttggcctccatcccttcctcaaccgtccgcagaacacctccttccagcaccttagctcctgcctccctctggacctattcagtcctcaagggtgccctgctaaaggctgggctgaaagctaagaggagaggtggcattcaatgtgtcctgtgtcctccctggggttgattaaggggtcgatgcccaatagagtccttcatcttggcgttcagcccagggtccagctgccaagggaaggcttggcaatcaagggtgatggagataagaatgaaaaggggcaccaccctgtgccaaagctggcatgttgtatatctgagagaggagctgcctattcacagtgtagggttgtcaagctggaggcagggagagaaaagcaagagctttttggttcctcttgaggatagaatctataggaaaatgtaagagggttaaaaataaatttcccatgcatccaaacttttttctttggtagactttcttgtcatctatttaaaatgaaacaagtgcatgtacgtggttaagacattttagctaggaatgatggtgcgtgcctgtagtcccagctacttgggaggctgaggcaggaggatcgcttgaacctggaaggtcaaggctgcagtgagccgagatcataccactgcactccagcctgagtgataaaagtgagaccctgtctcaaaaaaaaaaaaaaaattaaagaagttaaacagtgccgggcttgggggctcacgcctgtaatcccagcactttgggaggcccaggcaggcagattgcttgggctcaggaattcaagaccatcctaagcgaaaaaatataaaaattagctcagtgtgatgatgtgcctgtagtcccagctactcgggaggctgaggtgggaggatcacctgagcccagggaggtcaaggttgcagtgaaccatgatcatgtcactgcactcactccagcctgggcaacagagcaagactgtctcaaaaaaaaaaaaaaaggaaattaaataaaaagaagatagcagtttcccacctcattcttctcaaactcctcttcagaggcagcgggttttttttttttttgactatgtttttctactggctcactttattcctctaaaatagtaacttgtctatgtggtgccataacgggtccagtatctggacacgaggccgcactacctacacctttggggattctcggatcctgactctgagctacctcattcctagacacctggtgcaccacaatgtgtcagggatgtcggtttatgtgggatatttgcattttgttaggttgtgtgtggtagttgagcagccaagggggtagcatgcggtggatatttgttttagatacacagtaactggaaactcatttactgaggctatttggttaccctgaactactgtttctaccaaaaaggcaggataaatgctccctcaacacacacctttaattaccaattttcagagtaaggggttgaggtaatagccaccgccagttttccctttctctttgagtatcattatgagctcaaagttttttatatattcactatgattcaatcatgacagttgctatttttgatgctcaaattgccgcaaatctaatgtccaagtgttcttgtacttgtctaggcctagaatcttttagtgaagaaaaagtatttagaagacaaaaatcaggctgagtgcagtggctcacgcctgtaatcctagcacttgtgggaggctgaggcaggcggattgcctgagctcaggagttggagaccagcctgggcaacatggtgaaaccccgtctctactaaaatacaaaaaattagccgggggtggcggtgtgcaccttgtagtcccagctactcaggaggctgaggcaggagaattgcttgaacccaggaggcagaggttgcagtgagctgagatcgcgtcactgcactccagcctgggtggcagagcaagactccgtctcaaaaaaaaaaaaaatacgaaaaacaaaaaacataatctggattgcagggctgatcgttgctaatggagtgttatggctgttcagatgacagagggagaaaatgtactttgtaaactgttagttcaatgaggttatgattgcacaacaatgtgaacatacttaatgccactgaactttattgccattgataacttttaaatggtaaattttgtgtattattttgtcacaataaaaagtttgaaaatcgagttcataatatttccagtttgggccgaccacggtggctcatgcctgtaatcgcagcactttgggaggctgaggtgggtggatcacaaggtcaggagttcgagaccagcctgaccaacatggtgaatccctgtctgtactaaaaatacaaaaattagccgggcgtggtggtgcgcgcctgtaatctcagctactcaggaggttgaaacaggagaatcacttgaactcgggaggcggaggttgcagtgagccgagatcgcgccactgcactccagcctgggcgacagagtgacactgtctcaaaaaaaaaaaaaaaaaaaaaaaaaattccagattgaatttaatgtcacagagtttttagcctgtccacctgcccaattttgtattgtttcttttttttttttttttttttgagatgaagtctcactttgtcacctaggctggagtacaatagtgcgatcttagctcactgcaacctctgcctcccagactcaagtgattctcctacttcagcctcccaagtagctgtgattacaggcagcctccaccacacctggcaaatttttgtatttttagtagagatggagtttcactatgttggccaggctggtcttgaactcctgacctcaagtgatccacctcccttggcctcccaaagtgctggcattacaggcgtgagccaccacacctggcctgtgtctagtttctaatgttgttaatataagtagttatttacttattcaagaccagcctgggcaatatagtgagacctcaactctacaagaaaatttaaaaattagctgagggtggtggcacgcaccaatagtgccaaccattcagaaggctgatatggaaggatcacctgagcctaggaggcagaggttgcagtgagccgtgatcatgccagtgcactctatcctgggtgacagagtgagactctgtctctaaataataataataataccagcactataatgaaaatactgagtcaagtttaaaaaaaaatttttttttttgagacagagtgtcactctgtcgccgaggctggagtgcagtggtgcgatctcggctactgcaacctccacctcccaggttcaagcgattcccctgcctcagcctcctgagtagctgggattacaggcacacaccgccatgcctagctaatttttgtatttttagtagagatggggtttcaccatgttggtcatgctggtcttgacctcctgacctcataatctgcccgccttggcctcccaaagtgctggggttacaagtgtgagccatcgcgcctggcctaaaatttcttcttagttctttttgtccacagagactatcctacaaagaatatacaatcaaggtgttgagtttaaggaacttgaaataattatttctctggtgtttatattatcaattaaatatagttaggtccatttgatgtgttttcaacttcagggttcacttttttctcatttaattttattttttggtaagatacagcataagagagtcacatggtgataagacagaatcagtaatagaatgtagccctttaatgccaccagaaatccagagagagaaataagctagggttttattcagtagcagagtaatctccatccagggtctgcttgaagccctagtccctctctgacaccacaaggtccccttggctacctgtcaagcctcctggggactccactggaaacatctcagccgtagacagcaatcttcctctcacactgcagtttcaagatgatctggtattctgctgggaaattttgcatggtgttctcaaaccaatatttgtcatcccagtaatgggaccaccttttgcaattgtcttccccaaaaccaaacaaggatacctgagagattggataagacaaaagatggtggtggtgtaacgggctggatcctgccctgcccccatggaacacctatcatgccttcagcaccactcactcaaccactagtgtgccaggcttcctcttggagctgggaggagaatggagttcaccttcttcaaggaagacagactctaaatactcatagtgaccccagagcccagaaaagagagcaccaactagttgttcttcattatatattgagagaagagaggattcccctgggagacaagggaagggcattccaggcagagggagcaaggtgtgagaaggcgtgaggcagctggtatgtttggagaaccccaagaagtccagtgcgggaatctgggagagaggagagggagagaggagaggggtcagatcatgtagggtgttgaaagctaggcagaaagttttagatttaacgggaagtccttaggaagacagattttttttttttttttgagatggagttttgctcttgttgcccaggctggagtacagtggcatgatcttggctcaccgcaacctccgcctcccaggttcaagcgattttcttgcctcagcctcccaagtagctaggattacaggcatgcgccaccacgcctggctaattttgtatttttagtagagacggcgtttctccatgttggtcaggctggtctcgaactcctgacctcaggtgatcagcccgcctcagcctcccaaagtgcagggattacaggtgtaagcccccatgcccagccaagaagacagaaattttgagtggcagaggagtgaaagtccgtgagttgcaggagatatcttacctggtcacaggtatgcaaggcatacaacagagccacaaactccaaggacggatactgaccatggttctccagccaactttcctggatatacctgaggaagtagaggctgatcaccagcacctaggaagatggagaaagggactgacctgaagcctgtcccatggctacccactatcatgttgtcctaccactttcccctttccttcctgggaccctcaccttatctttgctgtcttcggttccaccaggaacctgaaccgtctgaaatctaaaaagaaattgaggtttgggaggatttcagagtcatttgacaagcagacttcagccttaagtaagccttgggggtgccccagtatccagccagggtctctttggagttacctctgtcactccctacagtgacctcactccctgacatacccagggttttttttgcttccacatgcttgtctgtttatgcagtacacttatgaaccactccagaccagatgaattcaacggaagcagcagcagttgggtaccggggtcctgagggctggcaatcccagggtacataacgcgcatggtggtcctgttccccacatctgcctcaaagcctcagacaggggcctggttcatcctgaaaaggaagttaggatggtcatttagaggaggaaaaggcttcggcttggtcttcgtctccacctcctaccctgcacccacctgaggaccacttcatgttgattaatcctgaagccaaggccagagctccatagagaccttgagtttcccaccactgcacagacccggcagttggacaccacatggcccagtgggcacaggggaggtgctttaatcagctgctgctgcttattctcaacctccttctctgacttgaccctctcgagtccctaggagcataggagggaagaatttaggggcttgacccaggttccacctacctgtggaagaaggttagagcctggggccttgatggagagatggctaggacctggggttgggtcagggactggacaaagaccaagtttgcgcactgaccagccacaatatcagagcatcattggacgtgggatcttgtggcctctgtaggggttcaacggtactgtcgaagcgtctgtcaaaccagtcagactcgccaggcacgtggaggcaggcagagcatgtgtggacctcagatgagcagttgcattttctggaaaagttgctgggatggtggcagattcctgggtgtatcttggccatattacggaggtccttctggctggagtgctggtgtaggaaggaggtgatcagccacaatgaaaggacataggcagccaccaggcccaaactcctgtatcgaatcatgatctctggccctgatgatggtgcccctggcagacagtagattggccccgacacctggcaccgggaagaagaggctggggccacagaagtccccagcatcccccatcttaatggcttccatccctctcccaacccttgacattacacctcctcccaaaacctcgctcctgcctccctggccacctactgatcactactggaactgccaaagcctggcctagaggcagaaagaaagggagagaggacactttttgtgttctgtggcctccctgaggaaactgattcctaatggggtcttctgtgccagcccagtgatatcagggactcatcacagaggccacgttgtgacctactccaccaaggcccctccttcaccttggcattcagcccagtgcccagatgaccagggaggtgtggtagtcaagggtccaggggacaggagggcacagagggagaggttgtatccaggctggggtgggtgagcaggaggcaaagagggaaacagaagggccaccttggcgatggctcacacctgtaatctcagagctttgggaggccaaggcaggaggatcacttgagcccgtgagttcaagaagggccacctggaatcttctgaagagaatttactatactgatgaaagagaatatttgatacctttagcccttaacacctctcaggggtcgactttttctttttaagaactgtttttttgtgttttttgtttgtttgtttttttgagatggaatcttgctctgttgcccagatcttggctcactgcaacccccgcctcctgggttcaaatggttctcttgcttcagtctcccaagtagctgggactgcaggtgcacaccactgtgcccggctaattttttttttacttttagcagagacggggtttcaccatgttggccaggctggtctcaaactcctgagctcaagtgatctgcctgcctctgcctcccaaagtgctgggattacaggtttgagccactgcgcccggccaatccagtgtatatcttacacttatagtgtatctaaattcaaagcgttttgtcagaaatacatgatttataaatttcataaaattttacagtcaaaaaagatttacatacccaagttacaataagcatagtgaaaagttttctaagaactgaattgttttgaaatttagattaattaaaataaatttaaaaattccttcctcacttgcatttgccgcatttcaagtgctcatccatcatattggatggtacagaaatacaggctaatttaattctaaaagtcaacaatctactattagtgtttacattattgtaactagataaatatttcctatagagtttgtaaatgaactaagactacctttttttgttcatgataattttttttttttttttgagacagaattttgctcttgttgcccaggctggagtgcaatggcatgatctcggctcactgcaacctctgcctcccgggttcaagcaattctcctgtctcagcctcctgagtagctgggattacaggcgtgcaccaccatgcctggctaatttttgtatttttagtagagacggggtttcatcatatcagtcaggctggtctcgaactcctgacctcaggtgatccacccaccttggcctcccaaagtgctgggattataggcatgatccactgtgcccggccttttgttcgtggtaactttctaagaaagggtgtgtaggagataaaacattctaagtttgcatgtctagaaacgccattattctgcttgcaggaggtagaattgtgttactttaaaaaaaaaaaatctttatgttctcacccctgatacttataaatgtgaccttatttggaagtagggcctttgcagatacaatgaaattaaaatgagatcatgctggatgagaatgggccctaatccaatgactagtgtgtttataagatgagggaaattggccgggcgtgatgacccatgcctgtaatcccagcattttgggaggccaaggcaggcaggtcacttgaggccaggagtttgagaccagcctggccaacatggcgaaacccagtctctactaaaatacaaaaaattagccaggcgtagtggcgggcacctgtaatcccagctactcgagaggctgaggcaggagaattgcttgaacctgggaggcagaggttgcagtgagctgagatcatgccactgcactccagcctgggtgacaagagcaagactccatctcaaaaaaaaagatgagggaaatttggaaacagaagacacaggggagtatgccatgtgaagttggaggtagagactggagtgatgcctctgatgcagggcaggcaatccccaaaattggggcttagcctgagagggttcttggctttgccctgatgcgatccagtggtgttagcaaactgtattgaagcagcattgcacagcagcagcagaggtacactgcttcttgtggacagggctaccccataggcagtgtgcccagagttagcagctcagcagcagctctgcaatcctatttatacccacttttaactacatgcaaattaaggggtgaattatgcagaaattttccaggcacaagcagtcctcctgcctcagcctcacaacatgctgggtctgagccactgtgcccagccaaaagtctgattttttattctttgttaactgtagcagttggattcttggtcttggtcaacagactggtaaacttcagagaaaaacaattcgccggctaaatatttagtagtttacaggatgatgcaaaagctagagaaccaggctcagtctatcatgagatgcaaaacatggccaaagactaccccaggaatggcccaccaggaatgccaccactgctgccaacacaactgggcccttgacactgtggtagtctcattatggcagattctcttcagctctttccattaggaagagcagttcatttccccacttcttggatcttggatcactttatgacttgatctgaccaatggaatgctgcagaagtgacacggtaagtgctaggcacagtgactcacacctgtaatcccagcactttgggaggccaaggcagtaggattgcttgagcctaggagttcaaggccatcctggccaacatggcaagaccccctttctacaaaaacaaaaattaaaattaactgggtgtggtgacatgcatttatagtcccagctactcagggggcttaggtgggaggatcacttgagcccaggaggtcgaggctgcaataagccatgattgtgccactccattccagcctgggcaacacagcaaactcttgtctcaaaaaaaaaaaaaaaaaaaaaaacgaattggaactgaggcacctaaaaaaactgggaacctcaaaatgctaaaccttctgtgaaaagctgggcaaaaaaacaaaaaacaaaaaacaaccctcaccctccggcatgggtgaaacaaggaggtttacttcttttatcgaagtgggtaaagagcctcccccaacaactcaaagtctgggtttgcacttggcatgaaattgaatctaaacttatacctcctacatgatccagggcactaggcaaagaaatcaactcaaatattgcccctgagatctggaaggcacctctggcccatccctcccagacactgtggttacaggtaagacaatcaggccaggattttattcagtaccagactgatcttacaatttcctcctgccctttacccacccagaaataggatttgtatggactcagctaggctgagcttgtgtgaatagtgagcttgtccacacgctagctgatggatgacttcgatttctgctcctgcactagacgtgggcagtatttccttggagcccttggtctgattatcctccttccagtgatagaaacactttccttgctattctgatccaaatccaaagagggtgacctagtggataagagagggacatgtgcgtcagcaggcagactcctgtcctcacccctgcctcccttcactcagcatctaggatgacaggttgtccctgggagctgggaggagactggagctcacctccaggaaacagactctggacactctcctagagtcactgaggatcccaaaaaagagaatgtcaactcgcttttcctcatggtattggaggaagagaggggaacccccaggacgtaagagaagggcattccaggcaaacggaatggtgcgagagaaggcatgaggcagctcatgtgtctggggaattctaagagcccattatgggagcctgggagacaggaggcaaggggaggagtcagaacatgtatagtctttttttttttctgagatggagtctcgctctgtcaccaggctggagtgcagtggcgcaatctcggctaactgcaacctctgcctcccgggttcaagcgattcttctacctcagcctcccgagtagctgggactacaggcatgcctggctattttttgcatttttagtagagatgaggctaccaccatgcctggctattttttgtatttttagtagagatggagtttgaccatattggccaggctggtctcgaactcctgacctcatgatccacccgcctcagcctcccaaagtgttgggatacaggcatgagccaccatgcttggcctacatgtagagtcttgaaagccaggcagaaaactttagactccatgctgaaggcattgaggagcaggaattttaagagaagaagatacaagaatctttcctgccggggcacagttgtgcaagacacagaacaaagccttgggccccagggatgaccctgaccctggtaagacagccagttgtcctggttgcacctggggaggaagggggagggaactgacctggggcccttcccacagcaacccacagccacatcctaccccttttcctattccccctcaccgtgtctttgctatcttccactccactagggaaccagaccatcttccaaaatctgagaaagaattggaggtgggggagtttgggccacaagacctgggaaagtcctgcaagtgtccccagtaagccaatagaaggtcttcccagagcccctgctgttactccctgcagtgacctcccctcacccccacacagagaatgtctggggacacctccatcaccttatcacttagagcatctgaagtccacaccaggtcagagagcttccgcagtagcatctccagctgcatccaggagccctggtcgctggcattcctgggatagatgaagcattgtgtgtggtttggttccccacgtccatctcaaagccctggacttggggcctgcttcatcttgggaaggggagcagaaactgatggaactgtggggcaggcctggccttcctgctcccgccctctccccagcacccacctgaaaaccacggggtattggtcgatgtcgttgccaaggctggagccctgcgggatctgtgggcgccccaacagcacacaagtcccacaatagaaatcaaaatggctcaccgagagcctgggaatccctttaaacagcttcctccacaatttcccaagctcgctccctgagttcatgccctggaaacagcaagagggagattgggggctgggcccaggggagagaaaacagagctgggtgggtgagatctccatccagaggctgtgaagacagggccaagggcagggatttgggcggaaagtgggagatgggtgaggcccggaaagcatgggggatatggccgggcccagtgttgaccactgaccaaccaccagagcacagtgtcagaggtcatagactctcttgtcctcatcaggtaccccatagtcttcctggagcacgcatcaagccagttccattcgtcggctgtgtggtggcaggaggagcagttgagggtctcagaagggcagccacacttcccggaactgaaccaagggcagtcgcaatgctgtggtaccaagtacattcgtttttcctggggtgctgattcaggtgtcagatccagatagggggtcatcagccagaggatgagcacccaaaagacccacaggacaaaaatctgccagcgcttcatgtctggcccaggcggtggctcccgtggtgggccgtagactggcttctctacctgtaaggatgaggggctgaggccacagacagcaccagcttccctctgtcctgtcggcctccacaactccccatcccaccaccttccacctccttccaacccctcctctcctgcctcactatccatttgctcaccctcaaaacggtctctgactgggcatggggtggaagaggccagggcagagagacagcatgtggctagtcctgagaggggaaggaatacctcagtgggggccttgctgtcatcccagttatatcatagatctcatcacaaagtacacattgtgacctccctcctttagcctgcctgaaaaaagccaccaccctaccctttctctgacaccgaaatgacctccactggatgtaagattcatgaggacaggggctgacctagtctctcttcttcacctctgcagctctaagacttagaatcatttaataaatatttatgggataaataaacaggggttgagagggaactttttttttttttttttgagatggagtttttgctctgttgtccaggctggagtgcagtggcatgatcttggctcactgcaacttccgcctgcctggttcaagcgattctcatgcctcagcctcccaagtagctgggactacaggcatgcgccaccacgcctggctaatttttatatttttagtggagacagggtttcgccatattggccaggctggtctcaaactcctgacctcaagtgatccgcccacctcagcctcccaaagtgctggaattacaggcgtgaaccaccatgcccagccgggaactttatttttaaattattattattattattattattattattattattattattttgagacggagtttcactcttgtcgccccagctggagtgcagaggcacgatctcggctcactgcaccctctacctcccgggtttaagtgattctcttgcctcggtttcccaagtagctgggattacaggtgcccgccaccacgcctggctaatttttttgtatttttagtagagacggggtttccccatgttggtcagactgatctcgaacttctgacctcaggtgatccgcccgccttggcctcccaaagtgttgggattacaggcatgagccactgcaccccgccccagcctggaactttaaatatacttgtgtgtgatgccctctctggagttgtgtgacatcaactcaatcctctcttgtagtctctagaccccatatccaacagcctactgaattgccacttagatggctcagagacatctcacctgaataagcctgagactgaacccaggattttccctgtaaaccaacccttcccaaaacttctctgtctcttttgttttgtttgagacagagtcttgctctgtcacccaggctggagtgcagtggcgcaatctcagctcactgcaacttctgcctcctccggggttcaagcaattctcctgcctctgcctcccgaatagctgggattacaggtgcgtgccaccaagcccggctaattttttgtatttttggtacaaacgggattccaccatgttggccaggctgatctcaaactcctgacctcaggtaatctgcccacctcggcctcccaaagtactgggattacaggcgtgagccactgcacccagcttcaaaacttctctatctcaacaaatggttccaccacgtacccagttattgaaaccagaactcatgtgttattaattcctcctactcctatgatacccaaattctttttttttttttttttaggacaaagtctcactctgtcacccaggcaggagtgcagtggcacaatcttagcccactgtagcctctgcctccaaggttcaagcaatcctttcacctcagcttgccaagatgctgggactacagaagtgtgccaccacgctaggcttatttatttatttaatttatttttgaaacagagtctcactctgtcgcccaggctggagtgcagtggcacaatcttggctcactgcaacctctacctcccaggttcaagtgattctcatgccttagcctcccaggtagctgggactacaggcgcacaacaccacacctggctcatttttgtatttttttggtagaaacggggtttcactgtgttggctaggctggtctccatctcctggtctcaagcaatccgcccacctcggcctcccaaagtgctggaattacaggcgtgagccaccgagccttgctgatttttttttttaagtagagatggggtttactgtgccagccctgtctcgaactcagctcaagtgatccaccctcctcggcctttcaaagtgctgagattacaggcataagccactgagtctggcctcaaatccattttttaattcgtttctatttctaagtcatcttcttcatctccactgccacccccttaattcaattgtagtcttgtaaagatagtaaaaaaatgaaaatgtttgagttgtttttaaagtttaagaaaaaaacagaacattttggtttttaaaaaaaatcaaaacattttattcaatgggataagaacagtaaaattcttcatcttaactagtggaaagctgcactggatattgtatagcttttaaatcaattcacccaaatatctgagtaaggtgtgtaggctagttaattatatcataccaacgtcaagttccaggttttgaaaaagtaccatatgggctgggcgcggtggcccacgcctgtaatcccagcattttgggaggcaaggtgggcagatcacctgaggtcaggagttcgagaccagcctgaccaacatggagaaaccctgtctctattaaaaatacaaaattagccaagcatggtggcgcatgcctgtaattccagctactcgggaggctgaggcaggaaaattgcttgaacccgggaggcggaggttgcggtgagccgagatcgcaccactgaatgtgattttagctgggcaaaaagagtgaaactctgtctcaaaaaaagaaaaagaaaaattactatatgtattatatggtaagacactaccattaagagaaaatgaaggccaggcacagtggctcgtgcctgtaatcccagcactttgggaggccaaggtggggtttgaagcttgaagccaggagtttgagaccagcctgggcaacacagcaagactctacacacacacacacacacacacacacacacacacacacacacacacaaaaaattagctgggcttggtggtgtgcgcctttattcctagctacttgggaggttcaggtgggaggatcacttgagtccaggagttaaaggctgcagtgagttatgatagcagcactgcactccagcctgcgtgacagagcaagactctgtctctaaaaaaaaaaaataaagcaaaaataaagaataaaatgggaaaatggatgatgggtacatgggaattttctgtactatttttacaatttcttgtgtgcctatggttttttcaaaatgaaaaggttttaaaaattatctaccagcctgggcaacgtagggagaccctatctctataaaaaatataaaaattggccattgtggtcccagctactcaggaggagactgaggtagggaatacttgagcccaggaagtcaaggcttcggtgatatgtgattgcaccactgcactccagcctgagtgacagagtgagaccttgtctcaaagaaaaaaaatcatttaggaaaagatgtatagcaagttttattgctatttcatttacatcaactgctataattttttttcttttttgagatggagccttgctcttttgccaggctagagtgcagtggcatgatctcagctcactgcaacctctgcttcccgggttcaagagatgctcctgcctcagcctcccgagtagctgggactacaggtccgagccagcacgcgcagctaatttttgtatttttagtagagacagggtttcaccatgttgaccaggatgatctcaatctcttgaccttgtcatctgcctgccttggcctcccaaagtgctgggattacaggtatgagccactgtgcctggccaactggtataatttttaaaatttttgtaaactcataaaatttaccattttaaccattttaaaaatattttggccgggtgtggtggcttatgcctgtaatcctagcactttgggaggctgaggcaggcggattgcctgagctcaggagttcaagaccagcttgggcaatatggtgaaaccctgtctctactaaaatacaaaaattagccaggcgtggcggtgtgtgcctgtaatcccagctacttgggaggctgaggcaggagaattgcttgaacccaggaggcagaggttgcagtgacctgagatcgcaccactgtactccagcctaggcaatggaatgagactctgtctcaaaaaaaaaaaaaaaaaaaaatatatatatatatatgtgtgtgtgtgtgtgtgtgtgtgtgtgtgtatatatatatatatttttattttatataatatatataaaattttattttaagttccaggatacaggccaggagcagtggctcacgcctgtaatcacaacactttgggaggccaagacaggggagggggatcacaaggtcaagggattgagaccatcctggccaacatggtgaaaccccatctctactaaaaatacaaaaattagttgggcatagtggcgcgtgcctgtaatcccagctactcaggaggctgaggcaggagaatcgcttgaacccaggaggcggaagttgcagtgagctgaaatcgaggcactgcactccagcctggtgacagactccatctcagaaaaaaaaaaaaaaaaagaaagttccgagatacatgtgcaggtttgttacgtaggtaaatgtgtgccatggtggtttgctgcacctatcaacccatcacgtaggcattaagccctgcctgcattagctatcctgatgcgctccctcccactggcctgcccaccaggcaggccccagtgtgtgttgttcccctccctgtgtccatgtgttctcattgcattttatccatttttttaatgtgcaaccatcatcactatctagtctcagaacacattcatcattccaagcatactctagtgaataatacattgaataagactagaatcaattacatgacattcatatccccactacccattttttccagatcttagcatttctttgcttttgctgttctggtgtttaggtatgaatatatgttcatttatcctgttacagtacattcaggcttcctaaatatgagaactcttgcctttcatcaattctgggtaattctcagccatttctttcaaatattgcctctcccttattctcagtatttcctcctattaggaaactcctattaggcaaatgttggattgtttttctttctatccttcaagtatctgaatctctcttttacatctatgattttatttctctatattacattatgggtaatgtttttcagctccatctttctgttcaatatttctctctctctctctcttttttttttttttttgagacggagttctcactctgttgcccaggctggagtacagtggccccatctcagctcactgcaaccaccttccaggttcaagcagttctcctgccttagcctaccaagtagctggtattacagacgttcatcaccatgcctggctaatttttgtatttttagtagagatggggtttcaccatgttggccaggctggtctcaaactcctgacttcaggtgatccacctgccttggcttcccaaagtgctgggattacaggtgtgagccactgcacccggccaatatttctctctttaactgtgcctaattggttgtttagcccttctactggtttttaaacttaaatgactatttttcatttctagaaattctttgaaatgtactttcacttttttttttttttctatggagtctcgctctgtcgccgaggctgatgtgcagtggtgcaatctcggctcactgcaacctccacctcccaggttcaagcgattctcctgcctcagcctcctgagtagctgggattacaggcgtgcgcctgccatcttgggaaagtcagttcacctcttggcttcctcatctataaaatgagacttgaagtagcacctaggctgcgcatgcgctggctcatgcctgtaataccagcacttttggaggctgaggcaggtggattgcctgaggccaggagttagaaaccagcctggccaacgtggcaaaaccccatctctacaaaaaatacaaaaattagctgggcatggtggtgtgcacctgtaatcccagctactcaggaggctgaggcatgagaattgcttgaacctgggaggcagacgttgcagtgagccaagatcacgccactgcactctagcttgagtgacagagcgaaactctgtctcaaaaaaaaaaaaaagcacctaactcccacgttgttttgagggtgaaatggattacagcaatgggcatattgtccatgttcagttagtattagtttctccttgtctttgctccttccttggtgagctgcggtcaggctgccacagtcacccaactccagggtccctcctcttcctttttatggaagcattccctaacccagcatgttagtcaccttcccttacagactcccatggtccccctgtgccacctcttatcaaagttttgatcttaagtcattgaatgatttgagctatgcactttgaaataaaacagactggagtttagatattagcttattagccactcaaagcttttaatcagggataataatagcagttagcatctaaggttgttgtttttgttgttgttttgtttttagagacagggtcttgctatattgcccaggctggtctcaaactcctgggcttaagtgatcctccctctcctgcctcagtctcccaagtagctggaactataggtgtgtaccactgtgcccggcctaaggttgttgtgaagatgaactgacatgatataggtgaagataaaagagtttacaacagggcaggtgcggtggctcatggctgtaatcccagcactttgggaggccaaagcgggcagatcatttgaggtcagagttcgagaccaacctggccaacatggtgaaaccccatttctaccaaaaatataaaaaattagccaggtgtggtggtggacgcctgtaatcccactactcgggaggctgaggcatgagaatcgcttgaactgggaggtggaggttgcagtgaactgagattgcacaactgcactccagcctgggtaacagaatgagaatctgtctcaaaaaaaaaaaaagagtttaccaccatatttgccacatagtagtggcttgacaaatgctaggtattttttttttttgagatggagtctccctctgtcacccaggctggagtgcagtgatgcgatcttggctcactgcaacctctgcctgccgggttcaagccattctcctgcctcagcctcccaagtagctgggactacaagtgcacgccaccatgcctggctaattttttgtatttttagtatagacaaggtttcactatgctggtcaggctggtctcaaactcctgaccttgtgatcctcccacttctgacacccaaagtgctggaattacaggtgtgagccactgcacccggccaatgctagctattttaaaaaaatattattattagctattatttttatttttattattttattaagggatatattaatatccataattaggactgtaactttctttctttctttttttttttttgattcggagtctcgctctgttgcccaggctggagtgcaatggcacaatcttcggctcactgcaacctctgcctcccgggttcgagcaattctcctgcctcagcctcctgagtagctgggattacaggcgcccaccaccatgcccagctaatttttgtatttttagtagagacggggtttcaccatattggccaggctggtcttctggcctggctggtctcaaacttctgacctggtgatccaccctcctcggcctcccaaagtgctgggattacaggcgtgagctaccgtgcccagccaggactgtaacattcttgaaggcaagaactgttctaattcaactctctcttcccaggactcaacacagggcagggacacagtgtgtgtgtgtgtatatttgagtgttgcttgcatacatggatattacattttaaaatctgaatttagtgcaatttttaatttttattttttaataatttttattttattttatttattttatttaattttcagacaaagtttcactcttgtcctccaggctggagtgcaatggcatgatcttggctcactgcaacctccacctcctgggttcaagcgattctcctgtcttagcctcccaagtagctaggattacaggcatgcgccaccacgcccggctaattttttgtatttttagtagagatggggtttcaccatgttggccaggctggtcttgaactcttgacctcaggtaatctggcctcctcggcctcccctagtgttgggattacaggcgtgagccaccacccctggccttttttttaaagtatttttgatacagggtctcactctgtcacccaggctggaatgcagtggcatggtctcgggtcactgcaacctctgccccccacccctgggttcaagcgattctcccacctcagcctcccgaatagctgggattagaggcacccgccaccacacccagctaagtttttgtattttttggtagagatgggattttgctatgttggccaggttggtctgaaactcctgacctcaagtgatccacctgccttggcctcccaaagtgctgagattacaggcatgggccaccgcgcctgggcttagtgcaatatttgaggcactcagattttttttttcctgtgctgctggttttggtcctatgtgggcaataaaacaaggaacctttcaggaaagtacttctcacactttaatgtgcatgctaattatctggagagtcttgttagaatgcagattctgattctgcaggtttggggtggggactgggattctgcatttctaacaggttcccagataaggccaatgtttctggttcaaggatcccacttagggtagcagagctttagacttaattccatcagcagattccttattacctatttctgatagaattcttggtgctctcaggaatctgaagcccagataatagagggagatcccaggtgtcctctgccaccctgttagctgagggagacccaaaaactttggcttccgtgaaaagtcctcctccagttgtccccaaagttgtagcatgagtccttccaaatcttttctcatgattatacaaatacatattcccccatataagattaagatttttatatatagatagattttttttttatttaggtttttttttttgttttttttttgagacggagtgtggctctgtcacccaggctggagtgcagtggggcaatctcggctcactgcaagctccacctcccaggttcacgccattctcctgcctcagcctcccgagtagctgggactacaggcgcccgctactacgcccggctaattttttgtatttttagtagagacagggtttcaccatgttagccaggatggtcttgatctcctgacctcgtgatccgcccgcctcggcctcccaaagtgctgggattacaggcgtgagccacagcgcccggcctatgttttacatatataacaatttatatataactacatatataatatatataacagtttatatatatatataacagtttatatatataatatatataacagtttatatatatatataacagtttatatatataatatatataagtttatatattatatataacagtttatatataacagtttatatataatatatataagtttatatataacagtttatatatataatatatataagtttatatataatatatataagtttatatatatgtttatatataatatatataacagtttatatatataatatatataacagtttatatatataatatatataacagtttatatatataatatatataacagtttatatatataatatatataagtttatatatataatatatataacagtttatatatattatatatatatatatgcacacacacaaagagagagagagagactcgctctgtcgcccaggctgtagtgcagtggtgtaatcacagctcactatgaggcaggagaacagggaatcagggtaaccgggggttaagacataagcaaatgaaggggtgcagccagttctaggcagcatacaggccacatcttcaatcctatgataacgagacagaagtttccacttccgcctccgattgaccgtggggccaaatctccacttcagcctctgattggctgtgggccaagtctccacttcagcctctgatttggtcgcaggccaatccttcataggtgtagccaactggaggcttctaaagggcacctaggggtgttgccaggtccctttagcttaatacaaaccctgattgaggaggctcttgagcagcttgctctaaccagctgccgctatgaatcgtcttcaataaatctatgcttttgttattccgttcttctgttgctgtttgtctttcgttgcccttctgttactttatgtgttttgttcaacacgccaagaacctggacaactctatgctggtaacaactgcaggtaacctggtaacaactgcagtttcaaactctcctgggctcaaccccagcctcccaggtagctgagactatagacgcatgccaccacacctggctaatttttttatttttatttttatttttggagacagaatctcactctgtcgcccaggctggaatgcaatggcatgatctcggctcactgcaacctccgcctcccaggttcaagcgattctcctgcctcggactcacaagtagctgggtttacaggagcacactaccacgcctggctaatttttgtatttttagtagagatggggtttcaccatgttgaccaggctggtctcaaactcctgaactcaagtgatgcttcctggctcggcctcctgaagtgctagggttacagatgtagtttttaaagtttttgtagagtggggtcttgctgtgttgcccaggctggtcttagactcctggcctcatgtgatcctcctcggtctcccaaagtgctgtgattacaggtgtgagccattgtgcccagcccaatttttaattaaaaaatggaatgatggaatgcacattactttgcatcttttcccccttaaaaatacattcttagtatacctaaaggagtaaatctacctcattcttttgaaaagtggcctaatattccatagaatgggtgtatcgtgatttattcaatttatttaatgtatcagtgggcattctggctggttccagatttttgccattgaacaatctcatgcatacatctttatgatgtggtgcacttaaaatctttaagagacagattcaatatcttaaggtgtaacaaccacccagatcatggtacttttatccttatattaaaatttttttctgttaaccttggatagctgcttacatattttttcttttttaaaatttttctattaaccttgacatggtgcttttacttcctaaagtggaattcctgtatgaaagcctatgagcttttatatcttactcattgcagctgcattactgtgggagctgtccctctagagacactgggctgcaatgggaagtgtcagggagagcttaagctccatatcacttgagtctaaacctggagggatagagcgtgtccgtgaggatcccagggcctggagagcaatttagggtaatattcagaaagcagcgctcaggagaagcactgggacgctgtttaggtaaaatcaacccaaaagaccctgattcccagagtactttgaggtccagaagaactgggctggaagcaggtcctgctattaattggctgtgatcttgggcaagttatttaacttctccaggtcacagtttgctctttggaaaacggagataagtcacacctgctttcagggcggacacccttactttacatcagaatcatccgatgccattcctagcgtttcggcttcagtaggtgggaatcaattatttgcatttctaataggtaatcagttgataatgatgcggccggtccggtacactcgaaaaaccactgttccaggatattccaagatgttccaagagtcttaaacacctggtgcagttccgagcacaaggcacacgaacggtgctattagcgtttctaaccccgcagagaactcctcgcaccccagtcctcaaaatcccgccccggacagcggaggcccgggcagtagcttccagacccaattgcccgcgcaagggggcgtggcagcatcgttgggcggggccgcctgtaagagaacgcggctaaaggtggggccaagcgtgcggtttgctgcgcctgcgtgaggaaaaagaggggggcgtggctccaggccggaagagggagtctgtaggggcgggccggctggcgtcccctttccggccggtccccatggaggcgctggggaagctgaagcagttcgatgcctaccccaagactttggaggacttccgggtcaagacctgcgggggcgccaccggtaggccgcagcggggccggggtcgcgtggaggggggcgtcctagagcttagcccgggctcctggactctgactggcctgccggtgtctgagggagcggattcgaggccattctgaccctcgccccttgtcctgcagtgaccattgtcagtggccttctcatgctgctactgttcctgtccgagctgcagtattacctcaccacggaggtaaggggcggggcttagtgcgtgggcggggcttggcattctaggagtaggacctttaggggtgggagtggggaaggagaggtttggggctaagtcttactgaggtagcgctgccccaggtgcatcctgagctctacgtggacaagtcgcggggagataaactgaagatcaacatcgatgtactttttccgcacatgccttgtgcctgtgagtacctcaccatgggtgggactggagagacccagggttctcatgtgggctgccagattcacacctccacccttaggttctggactggaccccaggacaacctccttctcctcatcccgttctgccccaagacaggcccagtatccccttcccctccaaaacccacatccccttgtccctagggtcccagtaccttagcctgattttcctgcttccagatctgagtattgatgccatggatgtggccggagaacagcagctggatgtggaacacaacctgttcaagcaacgactagataaagatggcatccccgtgagctcagaggctgagcggcatggtaaccaggggagggggccgggtctcagatcccaaagctggatgtacccaagcctatctgctagcaagtgaactgtggcaggcatagtgatacattaaacaactaagagctagagaagtcaagtgacttgcctagggtcccccagctagtaagagtcagagtgagctaaaatcctctatacatatcgagtcaggtaatctacctggctattattctcagaggtcctcaatacctgcagatggtagtttgaataccagaggtttgaagataggtcttatgtgctcttgccttggtagaactgtctagatggacccaggcttctttgagtgtttgctttcccagcccattggcttaattcagcccttaatgctcttcccctttggaatgcaggtggtttaatgagaatttaggttctcaagtcagattgcctgggttcacatctagctttgtctcctgcagtctgtgagcttcagctagaaagtggtaataaaacagtagtaccaaccacatggaattgtaagatcaaatgaagtcatatgtgtaaaatgcctggtacagagtgggtacccacttttaccttcctttcctttatcttggtggcttcccaattcccttcgttaactcagtttcccaccacagcaaactgtcctcaaagctgggatttctaacaccttagagattactctggtggggagttttatcattcgttgtttcagcagattaatgcaggacaccagtggaaccaacataatttgctataggactggatgtggagtggaggagagcaaagtcatggttgttgattccaacgctttcagcctgagcaaatgaatgacttgagatggagatgactggaggagaaggtttttttggtgggagggaggagtggctattggatatccactgctgtgtaacaaagtactccaaaagttagtagtttgatacaataaaaatgtgttttttcagtttccctgggtcaggaatttaggagtggcttgtttgggtgattcgggattagggtatctcacgaggttgcagtcatctaaggattgatggggcactgaagaatctactatctatctatctatctatctatctatctatctatctatctatctgtctatcttgagacagagtctcactttgtcgcccaggctggagtgcagtggcgcgatcttggctcactgcaacctccgcctcccaggttcaagtgattctcctgcctcaacctcccgagtagctgggattacaggcctgtgccaccatgcccagctaattttttgtatttttagtagagacggggttgcaccttgttgggccagatggtcttgatctcttgaccttgtgatccacccgcctcagccttccaaagtgctgggattacaggcatgagccactgcgcctggcctacttatttgttgtttaaatttattttttttctgtcaaggtgttctttatttcagagagagggcaggacagggggctcagtctttcttggcatcagctttcctcatgatggctgggacattgctcagctcctcctgcctcctcttagtgcggatgtgcgtccccactcttttcttgatgaacttgagggcccgtttgtccttggagaccttgagtaacaccatggcgtgccgctcatacggggcgaaaccacacacctctcggatcatgtcccacatgaatttggtgtttggtcaggcgcccgcggcggcagctgtgcctgggcttgctcatgttcttggtcatcttgtggcccttgtcaaggcacacggccatagtgggtagcacagagccatggctgctgctctccaatggcagctgtggcagaagggctggtgccacgcggggatctactttttttttttttttttttttttttttgagtcacgctctgtcacccaggctggagtgcaatggtgcgatttcagctcactgcaacctctgcctcccggcttcaagtgattcacctgcctcagccttctgagtagctggggttacaggcgcctgcccccacacccggctactttttgtatttttggtagagacagggtttcaccatcgtggccaggctggtctcaaactcctgacctcaggtgatccacccgccttggcctcccaaagtgttgggattacaggcatgggccaccacgcccagcaggggatctgcttttaaagggctcactcatagggctgttggcaggatgcctcagtgcctcaccacatgggcctctcagtagggttgcttgtgtgtccttgtatcacggcaactggcttcccccacttggatcttgcaagtgagctgagagaacaaagtagaaaccataacctttggccaggcatggtggctcacgcctgtagtcccagcacttttggaggctgaggcagttggatcacctgaagtcaggagttcaagaccagcctggccaacatggtaaaaccccatctctactaaaaaatacaaaaaaaaaaaaattagccgggtgtggtggtgggcacctgtaatcctagctactcaggaggctgaggcaggagaatcacttgaaccagagaggcagaggttgcagtgagccgagatcacgccactgcactccagcttgggcaacaagagtgaaactctgtctcaacaacaacaacaaaaaaacgtgtaaccttttttatgacccagcctcagaagttgtacaccatcatttctgcaatatactagtgcttacacaggtcagccttactcattgtgggagaggactacataagggtgtgaatactaggaagtggggatcattgaggacatcttggaaactagcttccacagagtaaggtcaggatttgcaggaaagaggaatctcaggtttggggtatgttaaatttggggttcctattttatactctggtgatattaagaggcaattagatgtaccagtctagaatttagaggagttatcagcaggtacagggtagtttaaacaactggactaagaaaacctggggagtcaatgtaggtagaggataggtctacggcctgtaccctgggtatctccaatatttaaaagtcaggacaggaaggaagattgggacggattagccattgacgtagaagaaccaagaggtgtcccaaaagccaagtggagagagtttcaagaagagagagtgagcagttgtatcagaagctactgatagtccagtaaaatgaggagtgagaattgaccattgaaattagcaacaaagagattcctggagactttgaaaggaacaattttgatactgttgaggatgaaaatcggatcaaagagcaaaaaaggaagtggagacattacctataggtgacttgggagtttcactgtaagggagagctgagaaatggagtgggatctgaaggagaaagtggtgagatggtgggtttggtggtgagagcaagtgaagttctgttgcttctcttttcttagtggaaattgaaagcaaggacattagctaagtgaagaaataggagggggttttgggagcctaaggagagaggagaaggtctaagtcaccttagagagtgggagagtgaactgattagagaaatgaagtggaattgccaggcagtcctaaaggagcttcaggaaagaagtaggtacagagagttgaatggaaccagggtgtgggttttgctggatttgtaaatgaaagacgagaggaacagggagttgtggttatgtgcaagagaataattacagtggaccatgggatttcaggagggaagtgaggacgtgatagtgtcagcagtgtcaaagaattggtggatttcgggtactaaatagtgaacttggaaaataagggtaagtagttgaagactcagacacttgaagttgaattttggaagatttgcagttattggcagtgacaggatctaggtatgagtatgaaaatgggtagctgaggtgagatggcaaaatcaaaagattatcatgagtcgggaggtcagtattcattattgaaatcaccagttatgatggggtgattagagtgaggcaaggagccggtgcagagggagaggtgtgaggagaagcaccatggcaagaggttagtggcatacacgttggaattagctgaaatctgtttcctcggttgcattgggcaaagtcacttctcatcagtgagcctcaacatcttctcagtaaaacagggataattaccgccaccctcaaagagtcattgtggggatgaaatgagatgatggttgtgaagtacagtgatctgtacacagctaatgttcagtatttactgttgactgttttcttactgtttcttttattaaaagaattgatatgtgtgtagaagtgcttaatgcctgacccgtagcatgtactatatgaatattagttattataacttttattatccctaagcaaagggcttgtgcagactggagccaccgatttcactgtgtctggccccagctgatgcctctgcttctcccctccccttagagcttgggaaagtcgaggtgacggtgtttgaccctgactccctggaccctgatcgctgtgagagctgctatggtgctgaggcagaagatatcaagtgagctgggggggagcgggagcagggttcccatcaggcgccatctgtcagtcagcctcagcctcagtcagactgtggcaggtggggaggtcagaccaagaatctagagtgggcggggtatgtgcctctgtcattgatcctggtgcaagcgactgaggctttgtaaccaggccctatctgggagctgcagacctagagatgaagctgaagtggtctctgctcttccacctagagaaatggttcagaggtggtctctggagtccagttacctgggttctacccctgtttccttgggccaagccatgtaacctctctatgtgaagagggatgataataacatcttctcgtaagagtcacatatggattagctgtgtactgtgtgtaaagcactgaggtggaaggcccagcccagattattagaccctcagtatctgataactgctgctgtttcccagaccctgacttctgcaagactgattcagcaggtctggagtggggcctgggaatgtgtacttaaatttttttttattgtgggaaaatatgtgacataaaatttaccattttaactatttttaagtgtgcaactcagtggcattaggtatcttcacagtgtcatgcagtcaccactctctgtcctaaaacttgtcatcgcctcaaacagaatgggaatatgtatttttcacagtcctagtctgggcacaatggcttacacctgtaatccgtagcactttgggaggccgaggtaggtgaatcacttgagctcaggagtttgagaccagcctgggcaacatagcaagaccctatctctaaaaaaattttaaaaattaaaaaaagaaaacagtccttctgccactgaggaaacacatttggagaatgtttggtggtcagggatgaggctagcagagccttcattagcaggcagagctgctcgggctctatttccccagatgccagcactggacttatgcctctttaacactctcaccgtcactccctgccctacaggtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtatcaggagggatcaagacaagatagggccagctgggctgggcaagctccactgggaaccgagggcccagtcaggccctgagtaggcaaaaggaggacacagccagtgaatgagagagaatgttccttacaggtggccggaaacttccactttgcccctgggaagagcttccagcagtcccatgtgcacggtgagtgatctgcactagctggggagatttagatgctggccaccttcttggtgagcttgagtggtcctcttctgcctgctgctcatttgtcttgggcaaccatttggccagagcaggccttcatctcagggcagcagtttggcacagtggctaagagcacaggccgaggagccagactgcctgcattcagataccagtttcagaccttactggctgtgtgactttgagaaggtttcttaatctttttgactcctgttttctactttataaaatgttgatgagggcacttatctcacagggtgtgtgtgcaggttaaagatgatagcacggagcctggcttgtggtaggtacttgttgaaatggtagccccccgtgtccgatgatgacctgtgcatgaggctttgggagaagcagagctaggttggagcacaggttctgccacacctgggctatgtcatatttgggccctatttagttgcttcttctgtaaaatggggatgatgataatagtacccactcacagggctgttggggtgaacaaatgagatttattctcattcatttgttcattcatgcattcacaaaatatttagtaatcacctactagtctagttgctaagggtacagtagtgaacaatctgtgccctcagaacattctagtaaagaaatagacaataagtatataaaatataaatagtccccaattaacaatggttcagcttgcaatttttaacttcatgatgggtattacatgcatttttcacttaacgatattttctttttcttttttgagacagagtctcactctgtcgcccaggctggagtgcagtggcatgatcttgactcactgcaacctccacctcctggattcaagtgattctcctacctcagcctcttgagtagctgggtgtacaggtgcgtgccaccacgcccagctaagttttgtatttttagtagagatggggtttcattatgttggccaggctggtcttgaactcctgacctcaagtgatctgcccgcctcggcctcccaaagtgctaggattacaggcatgagccaccgcacctggccgacttacaatattttcaacttgcaatgggtttattgggacgtaaccccagtgtaggtcagggagcatctgtatatggtatatcagatgctgttaagtcatatggaccaaaacaaggcaggataaagatggtaatggggaggggctagggtagggcagtgagggtcctattttaaatatggaggtcagggaaaaactctttgatgaggtaatattttagcaaagacctgaagacagtgagggagccagccatgtggatgtctggggaggaagtgttacaagcagagagaacagcaaatgcaaattcctaaggctagaatgtgcttggcaagttcaagatacagtaagaaggttagggtggctggagcagaggagcatgcttagaaatgaagtgagagaggccgggtgcagtagctcatacctgtaatcccagcactttgggaggccgaggcgggtggatcacctgaggtcaggagttcaagaccagcctggccaacatggtgaaaccctgtctctaccaaaaatacaaaaattagctgggtgtggtggcacacgcctgtaatcccagctactcgggaggctgaggcacgagaatctcttgaacctgggaggtggaggttgcagtgagctgaaattgcgccattgtactccagcctgggtaacagagtgagactccatttcaaaaaataataataaataaagagaggtcacagggccgtatcatgcagggcttgcaggggcattgtagggactcgggccgttactctgcatgagatgagaagccattgtagggccctgaagaaggtgaggcatgatctgacttaaaagctctccagctgctctgtggacaagactgggcaggggaaaggacagaatcagagaggcccattaggaggcagttgcagtgatcaatccaggcaaaagatggtggggcacggcccagagtggcagtggaagtggtgggaagtgactggcttctggatgtattttgaaggtagagctgagaagagttcctgatgggcatgagggataaaggaaaaaggagtcaaggatgcctccaaagttttgtacctgagtagtaagaaggatggagttgcctgtaatcctagcactttgggaggccaaggcaggtggattgcctgagctgaggagtttgagaccagcctgggcaacatgatgaaaccttgtctctactaaaaaatgcaaaaaatcagccgggcgtagcggcgtgcgcctgtagtcccagctactcgggaggctgaggtaggagaattgcttgaacccaggaggcggaggttgcagggagccgagattgtgccatttcactccagcctgagcgacagagtgagattccatctccattaaaaaaaaaaaaaaggatagagttgccatttagcaagatgagggagactcagggcaggtttagatgttcggaaatgggatcgtacagctggtattcggcttttgacgtgttcagaccaatagcatctgggtgtccttctagacacccaaggtgtcaagtaagttttccattcaagcctggagttcagggagaggacttgcctggagatgcagatgttggcatcatcagcatgtgtatagagctgtgggactggatgaaatcaccctggaggtgagggcagatggagaagaagggaagctcaaagggctgggtgccaggcctcccacattagaggccaagggtgtcagggggaattggtaggggagactggaggaggagtgtaagctgggaatgtggcatcctgccagccacggacgggtgtttcaaataccacatcagatgcttctggatgtcaagcgggaattgaccatggcatgtacatgcaacagtcacttatagccttgactgagtcatttaagggtgtgacaggaccaccctagagtgggttcgggagggaatgggggaggagttggagccagtattgacagctctatagtggaaattgcctaggggaggagagagcatgagctgaagctagagggaaatgtggagtcgagggaggcttttctaaggagggtgatgtagcagaatgttaatatgctgttggaaattatcgactaaagagcataagtgatgctccagagacgagacagtgaccggagtgaagtcctggagaaggagaaagaagacagaatctagtgccttacatatgtggaaagtccaaacttagcaccaggaggaagggcaggctctgtaggtacaggtagggtggtagctggtgtggcagaagtacatggagagtctcttctgagtcttcccatcttctccgtgttgtaggaaggaaggtcctcagttgagaatgaggagagagggaaggaggtgttggagatttgaaagaagaaaagatgtgactggtcacttgggggtggaagagtgcgtggactggggagattgagtaggattgatgcagccctagggcctccctggagtccgcggctgtgaatgcaaagagagcggtcagcatggttgtctgtgtgggaatggactcagtcaacagaacattgcaattgcatggggtttggtgttgccaggtgcctgcaaaggtgagggagtcaaatatgtaaagaactcatcttgattctggaccacagcatatgagctaggaaaggaggaaagacaggatgtggggaagccagtgagggggcaggaggaaaaagggactacaagtcctgagtgtagtgtcaacaagttattggaattggggaactggaggaaattagaaagctggtggagcatgagttgcttgaaattgaagtcacagaaggggctttgttaatgacaaagtttagggaatggccaacagagcaagtggcttgggtaggcagagcacaagatcagggaggaaaggatgtccaggaactgggaggcccgggtactggaaggatcatctacgtggatatggaaatcactagaacgtgtgacagaggtagtacaggagagagtgacaggcagttgcccaagctgttgaaaaatggcatgggaaaactgttctggaggttccatatcgatatctaggtgactgaaacaagcagggctgctttgccctgagcttcaaagctggggattttttttttttttttttttttttttttttttttttttttttgaggctggagtgccatggcacaatcttggctcactgcagccttgacctcctggactcgagatcctcccacctcagcctctcaaggagctgagaccacaggcacatgccaccatgcctggctaattttttttttttttttttttgcagagacagggtcttgccatgttgcccaggctcctgggctcaagtgatcctcccgcttggccccccaaaatgttgggattacagatgtgagccattgtgcatttttaaggcagataaagggaaagtgatctggaagtggcagtaaggagcaagaaagacttctctttaggccagggaagaggttgtgtatggagagaagatagtcgcacgttgaggggatgccagggagttagtgcctgaaaggaagagccaggctgaagcaagaaagtgaagaggaacccaggggttgaaggcagggttggggaaggtgggagttggtgtcacagtaaaggatggacagagctgcacagtgacagagcccagggtatgaagatggcctctcaaaatggttgaagtgaacaggaagaaagggccccctggagggtagctctgctggtcttcagggcaatctgtgggggtggggctgtgttggggaggggccagtgtgggggctggaggaccctgcagagctctgggaccccctcttcactctggaggaagctgggagaaaagggtcttgctgggagggcaggaagatgatcagtgtcaagctgttggcacaaggtctggcgggcactcagtagacacacagccagagtggcagcctcttggcctgggactgttagacttgtggatccccgggccgggggtgctctgtatttggaaggatgtataaatgcaaaggtacagttgcccaaggccagagatctggctgaattgaggcctgggagtgagtttctaacatccttgttgattggggctggggtgggtaataatctcttacagtgtaaagtttacaagtatttttccatcttagatcccacgtgatccttaggacagccctttgcaaaggagaacactgaggcccagaaagggcaactgatttgcccaaggccacacagtcaggaacttggctctttgagctctaggcctcttgtccttctaggccactattttgctcctctctggccagattagttcactctcgaggaggggcccagaaggaggcttgttagctggggccagactgtgttgctgaggctgaatgttccagtcttccctcctgcaacatatcttgctctcatagttctcattgtgaagctctgaatctttcttctctctcctccctcccccatgctgcagtacatgctgtggagagtaagtggccctgcccccatggaggccaaacccctacttctggggcagcctgccctactagaatggcggggaggttggatggggctgtgattgggtctcctctgacctggctgctgggtgactgtaaaaggtctgggatgtatctttgaagtatggttccttgcagcaggagggattgaggctagagggcaggaataaattgttctggaacagttggtacagggtccccatgggatttcttctggggagctttgagggtggaggcagggaaagtgtggatggcattctcagatcccacctcactttgaggttcagtgatttgccatcagctctagttagtgagagcccatagtcggtgggttttgtttctggagatgcaggcagggccatggtggtagtcaaggcatagagttccctgtggacgtcagggaggaaccagggtctgttctaaagactcctgaggagggcgtgaactctcacacaggcccaaggcttgccctttctggctgtccttaagcaggaccaggaggtgccaggctggagaaggaatgaggggcagagaagacaggtggtttgcagtccagggggaggaaggaggaggccagtgctgctcctactaatgacgccttctcccttgccttctcccttctctcctagtccatgacttgcagagctttggccttgacaacgtacgtaccagatggaaaccatggagggcaggtgggggtgggaggcttggttgctgccttcatttccttgtaggaacatcctgggatggggtagtgcatatggaaaaatacaccacgttctgaatggggatccagcctgagggttaagcgagagtgacttttgaactgaactctgagcaggctaggggcaagattggggttggataagagcatcctagacagacagagcctcagcgcaaggtcagacgggagcatggcccttctaaggaactgcggggcaggtgtggatgggtgaggctggagaagtcggcagggaccagaccacaccggactcagaggccacgctgaggaatcacatctttctcatgagaacagtggaaagctgttggccttctttaagcaggatcacgacataatcagatttgcattttaggaaagatccttctagtgtctgaggctgatacacaagggagcaggaagggagtgtatctgggggttcacagcctccagcctaggcctccaggcaaagccagcacctgctactctgtgtgcctaacgtacaagtgaagctggtattttaagaaatctggaacctggccaggcatggtggctcatgcttgtaatcccagctactcaggaggctgaggcaagagaatcgcttgaataaggcgaggctgcagtgagccaagatcatgccactgctctccagcctgggcaacagagtgagaccttgtctcaaaaaaaaaaaaaaaaaagaaaaatctggaaccccaggagtttgcaggctgtggaaggaggagtttctaggcagggaatgggggattcttatctcggggaggttgtccccttaggaccatagcctccccttcctcccacatctccgcagacggacccaggtgtccctgtctgctactgtcatcagagctttggatgagctctggatggtgttgtttacagatcaacatgacccactacatccagcacctgtcatttggggaggactatccaggcattgtgaaccccctggaccacaccaatgtcactgcgccccaaggtaccagcccgggaggcagcccccagccgcagaaggccggccgggcacccatacccagtgctttgttttcccctcagcctccatgatgttccagtactttgtgaaggtggtgcccactgtgtacatgaaggtggacggagaggtgagtcagggagctccctaccagagtctcctgcgcggtgccaagcactggagttcctgcattttgttccgtcagcctggggagtgaaagctgcctcgtcctcacatggcgaataaaagactgaggcacagagagggtgggggatttgccctcccaggcagagtgcaggcctggggctgttagatttaaagcgcctgctctttctgctgccctcaccgcttctatccgttcctccggtgcccaccgtctgcctgcctcactgttctctgtggtctgcctgggctgggggttaggcaaggcaagtctctgtgtacccgctcccaaggctgccctggcctgtggagcagcatctcagcagagtggcaggatgcgaggggctgagggcagaggaagtcaggtcagccttggtgcgtctttggagagctgcttctcagcctggacccccgtgagaacacccaccaaatgctgccaggataggtaaactgtaaagacttggcacctggaggggaaggctgaggccaagactaggagagggggtctggcgggccaggccttgcagtgcaggccactagcacggtgctgtgttctctccttacacggccaaggctcaacaggaaaggggaaggagcaggggtggggctgatggtggctggagccaggtcctagccctagccctggcccaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtgaggatgggggcaaagcggcctctgggggcctgggcctgagggaggaggatgcctgctgagcccaccctctccttctaccaggtccttcacccacttcctgacaggtgtgtgcgccatcattgggggcatgttcacaggtaagaggcccagggcgtctgtgagctgtggggtggggagggtaaagcctgggtgccccaggtttggttgggggtgaaggggcagatgctggcctggccagttaagtgacaaggctctcagcgtcaaaagccaaggcccccactgggccagtgccagcccttgtctctctcccagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtactcactggtctccgtgtgatccttgccatggccagagcctcatcctggccactcactgaaggcaattgtgactgacagatcggggcccagagccctcgggagccccacatgggcatcccctagttaaccggggtttattcaaaccagattcatgtccagcccacagccctgtcctgggtccctcctccactgtggtcctcaggcctctcgggttcagccccagggctcagatggaccttttcagcgtgagcttcctggagccaccatggcccccaggctcatgagtgatcaaccccaggccactaattcagggccctgagtgcatattggggcttgccacttcttcattgatgggtaaagctggggccgctctccgccaccctgggctcaatacacctgatcctgtcacactcactgatcccactctgtgccaaaccccacgctggctctcactgcagagaggaatccctccaggtcctctgcagtctagatggaagcaaaactgaacactgaggtgcgaaagtagcagtcagtggccattctggagcagggccagcaccagacccctggcttggagcctaatcagggtttcccattagaactctggatccatgtggagaaccagggcccagcaacctcaccagtccacagcctagggaaccaggggtacctaaacagccagtcagtttatcagatcatgtctcgaatgttgatgcaagactgtggcaggggaaaagcgagagagaggggaaaggaagcgaagtcaggtagtgacagcagaacttttagctctgatggaagcctctctcagggatggtgaggaatggacaggttaatggagtccgtcaggtccttagctgtcctggaggggtggaagccagaaacagattaggtgagagggacctgccaccagcaggagcaggagcagtggtggagtgggtgtgataactcagctgccggggcccttttcttccctgtggtggggatgggggcagccttccatccctgtgcattcttcaagtccccagcacctgaggtcacccaagaacatctctgttctttgccacctggtgccggccttgtatagcacgtgatcacaggtcagtggctgtgataggtttattcagaggaagcactagactctggggtagctcacatgggtaagaaagacttccaggagcaggcattgaagggttggcaccctgggtgagtgtccaaggtcagcgagagtcacttgtggaggggacggaagatgacctggctgatctggccagggatggtgtagaagaccaggaggaggaagacggtgagcagcaccagtagcagcagcaccagggtgcgccagtaccggcgccagatgaagaagacaaaggtcttcagcgggttcacaaaccagttgaaggaagttttggggcggctgttgaggagaagagtggtgtcaggatgaggaggaagccccttgaccacccccacctccccatcggcccaggctgtggccccagccccggtgcctgactcacctgggtttctccagaggctctggctgcttccgccccttccccactggccgtttctcggcctcctccacagtcagcagctcaaactctgcctccaccttgccctaaaaaagacattcctgcatcactgggagcagggggcgggctcaggccccagctcagcctggcctctgcccacgggcacccaccgtgaggatgtacacattgccacccatgtctgtgaactccaggtcttctggccggcccttcctcctcctctgctttcgcttcttcttgccagcctgagcctcctgcgcctcccgctccacgtcctctgcctccttcagcttcactaccggccaccagcccctcaggcggcggcagcgaaacagattgcacctcggcccggccccattgcgggccagctgcacagagcagagctcggggccccgggccccacgcaccatgtctggtagctgcaactccagggatcctgcaagtccagagcacaccagattaggcatgggatcaaagtctcattgtgccaggggtgaggaggcaacacaccaaggttgtaaattggggcattgaaagttgttgcagtgtgcggtcaggccacagctatagaccacccagaccacagcccagcggtccacccattgctacttcccagtggaagagggccaagggtcgggatcagagtgccaaggaccaaaggctgtggagtcggtgtcagggtgacaagctagggtcaaatcagagttgaatcagagactctgggtgggaatggaggttactgtggtctaggcctaattaactcagtaattaggccagaaagcaaaggtttcacacctcgggtccaaaatcccaagattcaaggttgggtcagagtagggaactgggggacggaagtgagggctggaggcaggggcggaggtgagggctggaggcaggggctgagggtggggaaggctaagcattgtaataccaaggaagtcattggcagagatgcggtcatagtcccagacctgcaggaccagcactgcaggctgccggaactccgcctcctccagggcaaagggtccagacctgcgccagacgctcacctcccgctccgtgggcaggtagtcaaagcggaacacaaagcgccaattgaagttcccctccccagtcagggagttgaagtgaacgtctgtctcctgcttgtcatgctccaaccccttcacccagctggggccggggtgggtgagcgtcagggctggagctacatggagaacccactcctcaccccgctctcagcaccacggagggcctggggtcggggctctggactcagcccgagggcccacacccatttgcaatccccctagtgcaccgccgttgccccgcccggccagcagcctacctcttcacatagatgtcactcgacatctctccggtgagtggattctcgtcatccagaaccacatcctccgtgttccagatgacaactctgagctcatagctggggggcacattagggggtggcttcagactctcgagtggggccctaaaaggggctgcaggaagcaggagggacctgggccggggccactgacattcactggacacctgtgtgcccagcaggggaatccaatgcctgtggtcccatgaagggaagccccaggtgtcactgaccaccctggccacagcagatggccccaggaatggtctgtggggccagcgaggttctccttcccgtgaatttagaatcagggcgctgcactgttgcatggtgtggcatcagatgcaaagctggagctaccacaagccagagtttggggatgtagaaaagtgagtgaacagaaagccagtctgcagggagaagagggaggatgagagatgggggacaggagcatacagcgcctgagggacaggagggctgcgacactctggaccctacccgcatatagccctgtctttgggggccatggggttgcctggatagctgttttctccagcccagcatcaatttcccctcatttgttgacagcaccgtgattttctgctggtgacccacccccaccccaaccacccctccccaccaccactgtcaatctatggaattctggtggggcaggcccctccctccctggctggacggggtcggggagacatcactggactggccaattcgagtattacagccccctaaccacaatgattggttcttcagggcacagcatttgacccaagctggtcggctgagtcagccctgaggcttttgctgtaactgggaaagaggtgtttgtttctgctcaagtggcctggctgagatgtaagcctcgcactgttagatgccactttgcccccagccctgcagagggctccctgagagcgacaccaaggaaagcagagcccagaggcagaaagtgacaggctgctgatatccgagcatctgcattcagccctgtgtgaagtggctgtgacccacacacaactccactcagatgagcttaggtgggaagggggcttaccaaaaggtacttggactcaatttacaagagacactcaacttgcaatgcttttgaataacagggaatttaatgacacctaactgaaaagcctgtgatgagcaacctctgcctgcttcactggggacccgggttttcagaggagccttgtacaggtagaccaggatgtgcacccgccttgggaggaggcgacagaactctcacctgattggctgccgaggcttgatgtcaactgggggtggagcaggcacatcttgaggaaagatgtcaatccacatgtgaagagatccctggggggacaggaccaggctggagggtcttgccaggctcccaaccttccctgacagccctatggccacaggctgtgccttgtccccaagtggagaaaagagctagggtcaaaatgacagggtcgggtagatcctgggggatgaggatgaaggtggagtctgaagtgtgggttccaggatcaaggttagattaggggttcaaggatgaggtccaggctgggcgcggtggctcacgcctgtaatcccagcactttgggagtccatggagggtagatcacttgagctcaggagtttgagaccagcctgggcaatatgacggaaccctgtctctacaaaaaatataagaactagccgagtgtggtggcagacgcctgtaatcccagctactcccgaggatgaggtgggaggatcacttgagcctgggaggtggaggctgcagtaagccgagatcatgcacctgcactccagcttgggcaacagagtgagaccccatgtcaaaaaggaaaaaaaaaaaaaatgaggttccagaaggggaagttgagattaaaagtaatatctggtgttccaaggtccagatcttagggatctggggggaggtcaggttaggaaccccacatctgagtcttggggcccgggggtggggatcctgtaggactagggtcagggtgaaggtgtggtccaggatggaggtccaagatgagcagggacacagggaccagcaacaggagctgcagtcaggagctgcaggtggcacccaggtggacatcttggggaaaggctgtcctgggggcccagggtccaggatcaggtgggtgtcctgggattctaagagtcttgtgattctgggcctgggtgctgagccctcccacacctgtagcagccctgggctgtggggatggtagagaggcctggtttctacatgctcgggtaccagctggatcccaaaacccggcatttcctgccagcgccgcagcacaagcaatgcctgggcctcttcagggtccccgctcgccactgtggggctgctgctgcctgaagcaagaggtgtgtgagcttagggctccacacagtttccatctctcctcccgccctccccccccccccgcccccccaacagaagctctaagctggggaagccactgtgttggataaagccctgtggactaggagagcagctctgtaatgcacaaaaagtgggagacgctgctataactttgcccagtgaaaagccagcagtcagtgggacagtgggattggaggtactgccacctttgcctagaccctatttagagaataagccaccagagcaggcacactggctcatgcctgtaatccgagcacttttggaggccaagatgagaggattgcttgagtccaggagtttgagaccagtctgagcaacatggcgaaacctcatctctaccaaaaaaaaaaaaaaaaaaaaaaagaaagaaacttaggtgggcgtgatggtacgtgcctgtaatcccagctactcagggggctgagatgggaggatcacttgagcctgggaggtccaggctccagtgagctgagatggcaccactgcactccagcctgggtgacagagcaagaccctgtctcaaaaaaaataaataaataaaaaataagcctccagccatttaattctgcagccacattctgttatatggggcgctctatgggacctctgtgttccgggaacttgattagttatgggtccactttggctctttgggggaatctcacactcaccaataaagactgttttctccctaatacccaagaacctcgtccttactcaaccaaattcacatctacttgctgaagaaatgggttattttggggagcacacaagactgggccccctgtaccttgttctaccgacatcttgcttgaacagaaaggggctgatacctgggggcagggtctccggtggtgtcaggaagactttgctgcccaccttgacagcaccggctcggtattcaggggcagggaggccacagcgttggcacagccccgccaggatctgcgaaggccagaatgcatcacgccaggcattgtaaccatctctacaggcagaaaaagaagatgcgtcagctggggctggtgtagggacacagctgggcctggggcagtgatgacgtcatgaagacatgaggtctaggttcaaaactcccaacgggagacaggttagtcctcatttatgataacaatgaatgaaaaaaatgtagtccaggtgcttccattaagaagatactgatcttattacctctgttttgcagatgagaaaacagacttgaagaggttaagagggcctggcatggtggctcacacctgtaatcccagcactttgggaggcagaggtgggtggatcacttgaggtcaggggttcaagaccagcctggacaacatggtgaaaccctgtctctactaaaaatataaaaattagctggacatgggggcccacgcctgtaatcccagctactggggaggctgaggcaggagaatcgcttgaacccaggaggtggaggttgcagtcagccgagatcgtgccactgcactccaacctgggagacagagcgaaaatataaaaattagctggacatgggggcccacgcctgtaatcccagctactggggaggctgaggcaggagaatcgcttgaacccaggaggtggaggttgcagtcagccgagatcgtgccactgcactccaacctgggagacagagcgagactgtttcataaaaaaagaaagcggtcaagtgacattcgttacaggatcccgactcccaagcccaagtcttgaccactgagctatgtcttggttggcagtggcggtgggtgggagggtccccttccatgaaatcataggatctggagacacaaaagggaatgtgagcttgaatgtgtttggccagaaactcagaatggctcctgtgggccctgctggacccacacttcatactgggaggccagcccacagtttgctctgtggtggctatagaatcggttttccagatcaatgtgggtctccccgatgaggtcgtcagaacccacgaggtcatgatcaaatacggcgaccgtcagctccgtctcagctgggagagagatgcttagctccaggatcctggcaaggagggagagggactgaggtcacttccatgctccaggaggtggtctggggaggaggcgggtgtgtcagcatcccctgtccattcccttgccattcctaggccagctgccacaaggccacagggctggatgctcctgcagctaccccgtttccaccccacagggcccagcctcactctccaaagatggggttgagctgcttggggatgtagcgttccttggtgtcctgccgctcccggccagcgctcaccaccacgtaagggtctgctttgccattggggtctgcaggagccaggttggtagcctaggggaacagcatggagtggaactgagagaaatgtcattatgataacccaaggttacctttgtaggacctaatttcccattgggtgaaagcaggaagttatcaaggagagatctcccactgtgaggagctaatggagaggttggacaagatgacttttattttcaattagttatgaaatagttaagtcatacaaacaggtataacaaaaagtgtaatgaaacaaaatattttgaaagatgtataacggacttactattcaactcataactttctatatggtttgacttattttttaatttatgaatttttttaatagagatgagggtctcactatgttgcccaggctggtctcaaactcctgggccgggcgcagtggctcacacctgtaatcccagcactttggaaggccaaggcaggtggattatttgcagtgaggagtttgagaccagcctagccatcatggaaaaccccatctctactaaaaatacaaaacttagccaggcgtggtggcgcacacctgtagtcccagctactcaggaggctgaggcaggagaatggcgtgaacccgggaggcggagcttgcagtgagccgagattgcgccactgcactccagcctgggcgacagagcgagactccgtctcaaaaaaaaaaaaaaaagaaagaaagaaagaaagaaagaaattacatcctgtgtagttttttccccccactttttatagagacaggggtctcacactacattgccaaggctggtgttgaactcccggcctcaaatgattttcccacctcagcctcccaaagtcctgggattacacagtgtgagcctctgcacctccagccctgtgtagtttcttgactgaaagttgttgggtgattttttcaattgttgtttgcctaaagaggtctttcatttttttctctcttgaatgagtgtttcctaggacacacaattcaagggtgatagttatttttctcttagtgctttgaagatattattctatttttcttccagcacttttggttgctgtagagaagttgatgggctgactgtcattccattgtggtaatctgtactttctctatgatgatctttacatctttttaatttagagattgggtcttgttctgttgcccaggctggtctcgagaactcctggcatcaagcagtcctcccacctcagccttctgagtagctggggttacaggcatgagccactgtgccaccttgattatttttttggtatttatattttccatagcacttatgctttcttcttttttttttttttttttttccctgagacagagtctcgctctgttgcccaggttggaatgcaatggcatgatctcggctcactgcaacctctacctcccaggttcaagggattctcctgcctcagcctcccgagtagctgggattacaggcacatgccaccacacctggctaatttttgtattattagtagagaacggatttcaccatgctggccaggctggtctcaaactcctgacctcaggtgatccgcctggctcagcctcccaaagtgctgggattacaggcgtgagttatcacgcctggccacacttatgcctctctaacgcactgaaacatttacttattttgttaatgtttgtttctcctactagaatgcagtcttcataaaggcaaagctttttttctccttgtgattacatattaattttattctttgaaatctctttcttctcttgtcctgtccaaatcctacttagagatactcagtcaagccttaatttcctgtgctggctcggctcagtggttcatggctataatcctagtactttgggaggctaagacaggcaggagctcaggagttcgagaccagcttgggcaacatggtgaaatcctgtctctactaaaaaatagaaaaaattagctgggtgtggtggcatgcgcctgtagtcccagctacttgtgggggctgaggtgggaggatcgcttgagcctgggaggtcaaggctgcagggagccgtgatcatgccactgcaccccaccctgggcaacagagtgagaccctgtctcaaaaaaaaaaaaaacccgcgaatttactgcagagacagtaataaaggagtatggtagtggcataaacatagatcagtagaatagaactgagagtccagaaagaaatccacatatctatggtcaattgatcttcaacaagggtacctagaccattcaatgggaaaagaaccatctctccaacagatggagctgagacaactggacagtcacatacaaaagtatgaggtcagaccctcacctcacactagatacaaaaactaaccccaaatggatcacagacttaaacatgagagtcaaaactcaaactcacagcagaaaacaggcaaaagtcttcatgaccttggattttgcaaaggtttcttagctataaccaaaaagcacagtcaataaaagaaataaaaatagacttcatcaaaattaaaatctcttttgctttaaaggacactatcaatagagtgaaaagacaacgtagaaagtgagaaaatatttgcaagccatataaaaatctagtagccagaatatacaaagaactcctacaactcaacaacaaaacaacaatctaattttaaaacggacaaaggactttagacatgtctccaagatatacaaagttctaaaaaccacatgaagactgttcagtgtcattaggaaacaaatcaaaaccacaattagataccactttatacccactaagatgatcttaattttttctttttcttttttttttttttttgagtcagagactcgctctgtcacccaggctggagcgcagtggcgcggtctcggctcactgcaacctctgactccagggttcaagcgattctcctgcctcagcctcctgagtagctgagattacaggcgcctgccaccacgcccggctaattttttgtatttttagtagagactgggtttcaccatgttggccaggctggtctcgaactcctgacctcgtgatccgcccacctcagcctcccaaggtgctgggattacaagcatgagccactgcgcctggcctgacattcatttttttaaaaggacaataaaggctaggagcagtggctcatgcctgtaatccctgcactttaggaggcctaggcgggtggatcacctgaggtcaggagtttgagaccagcctggccaacatggcgaaaccctgtctctactaaaaatataaaaatcagccaggcgtggtggcgagcgcctgtaattccagctacttgggaggctggggcaggagaatcgcttgagcccaggaggaaagggttgcagtgagccaagatagcaccactacactccagcctgggtgacagagcgagactctgtctcaaaaaaaaaaaaaaaaaaaaagaaaatgtaagttatattctggcactcctttgctcagaaccttcctatggcttcccatgtaattcagaataaagtgaataacaaaacccaacatgatctgctttctctgcccatcactgctccatttcctctgaagccttaattcctaaaacctgttcatttatcctgcctgctacggccacaaggggccccttgttgtttgtcacacacgagtcatggttctacctgatggcctctgtaccagctgttctgcctggaatgctttctccctcaggtagccacctggataactccttggccccctcctagtgtgtatttaagagacagggtctctctctgtcacccaggctgaactgcagtggtggcatcacagctcactatagcctcaacctcccaagctcaaacaatcctcccatctcagccttcctagtagctgggactacaggtggaagccactgtgcccaactctagtatttgtttaaataacactttctcagccgggcatggtggctcattcctgtaatccagcattttgtagttcgagaccagcctgggcaacatagcaagacctcgtctctaccaaaaaaaaaaaaaaaaaaaaaaaaaagtcttattgaggtctatcaactccgaccatccatttgcaacccacccccagcactcccccatccctttatcctgacatattttctccacagcacttataattttctaacatataaataagatatataacttttttttgttttgagatggagtttcgctcttgtcgcccaggctggagtgcagtggtgtggtctcagctcactgcaacctctgcctcctgggttaaagcaattctccttcctcagcctcttgagtagctgggactacaggcatgtgccaccaggcctggctaatttttgtatttttagtagagacgggttttgtatgtttagtagagacaggagttcgggctgatctcgaactcctgacctcaggtgatctgccccctcctcagactcccaaagtgctgggattacaggcgtgagccaccatgcccagcccgtaagctatataatttacttattgattatggttattgttcatctcttttcactagaatgtaaagttcacgagggcactgattttcatctgttttactcactgctttttatcaccagtacccagaacactgcctagtacctcataaaaaatgcaagaaaggccgggcacggtggctcacacctctaatcccagcactttgggaggccaaggcgggcagatcacctgaggtcgggagtttgagaccagcctgaccaacatggagaaaccctgtctctactaaaaatacaaaattagctgggtgtggtggtgcatgcctgtaaaccccagcttgaggcaggagaatcgcttgaacccaggaggcggaggttgcagtgagccgaaattgcgccattgcactccagcctgggcaacaagagcgaaactccgtctcaaaaaaaaaaaaaaaagaaaaaaaaatgcaagaaatacctgtggaataaatgtttgtgagtgaaactggcctagaattatactttctcatgtcattcttctcaggttttgcatcaacattatgccaccctcatggaattaactggggtatttctttttatattctctgaaatggtttgtgtaagattaaaattgtttcatccataactggtggaaactgctgctgagaccatttggtctggagtttctgacacaatttcttttaatacttatagtactattcaggttttctggccaggtatggtggctcatggctgtaatcccagcactttgggaagccgaggtgggtggatcacttgagaccaggagttcaagaccagcctggccaacatggcaaaaccctgtctctactaaaaaatagaaaaatcagccaggcgtggatgcaggcacctgtaatcccagctactcaggtagctgaggcaggagaattgcttgaacctaggaggtggaggatgcagtaagccaagattgcaccactgcactccagcctgggcgacagagcaagactatctcaaaaataagtaagttttcttcctttttttctggcacactgcatcctcagtggctcaagcaatcctcccacctcagcctcctgagtagctgggacaacaagcaggaaccaccacgtccaggtaatttttattttgtttttattttttatttttttttttgagacagagtctagctctgtcgcccaggttggagtgcagtggcatgatctcagctcactgcaacttctgcctcccaggttcaagcaattctcgtgcctcagcctccctagtagctgggactacgcacatgccaccatgccctgctaatttctgtatttttagtagagcattggggtcttaccatggtggccaggctggtctcaaactcctgacctcaggtaatctgcccaccttggcctcccaaagtgctgggattacagaggtgagccactgcacctggcctaacttttaaatttttttgtagagatagggtctcagccgggcacagtggctcatgcccgtaatcccagcactttggggggccaaggggggggcgcggatcatgaggtcaagagttcaagaccagcctgaccaacatggagaaaccctgtctctactaaaaatacaaaaaattagctggatgtggtggcaggtgcctgtaatcccagccactcgggaggctgaggcaagagaattgcttgaacccaggaggcggaggttgcagtgagccgagactgtgccacagcactccagctggggcaacagagtgagactgtgtctaaagaagaaaaaaaaagtggacgttgtagtgaagggattgggaggagattcgtggatgtaatgaagatacagcttagactacacgctgtatctattttacaggggagagccaaaggataagacagctgggaggagctctcctggggttaaaacaaatatcaaacactaacctcagaaagtattcattggaaagagccaccatttgattagatttatttgtagaggattttatgctcccaggatactactgcaaatgacagagcaataagtagagcttaactgggtgtggtcagggaaaagaatgcaagagggccctaccagtaccactgtcatcctagggtgacagtggtatatccaaagctgcacctgccagagtagcaacatcagtgatctaacacaggggatgggaaatagactttgctaaaataatccagccagtcactaaacaaataaacaagcaaataacaagaaacctcagtacccagagttgctatcatatattatctaaatgctgtttccaacaaaaaattatgaggcctgcaaagaaatagaaaaattatttttccatccaccccccaaaaaatgcccgtgagagcaacacaatgttgaacttaacaggaaagtatgtatgtgtgtgtgtgtgtatgtatgtatgtatgtatgtatgtatgtatgtatctatctatatatatatatatatattttttttttttttttttttttttttgagacggagtcttgctctgtcgcccaggccggagtgcagtggcacaatctcggctcactacaagctccgcctcccgggttcaggccattctcccgcctcagcctcccgagtagctgggactacagtgcccaccagcatgcccagctaattttttgtatttttagtagagatggggtttcaccatgttagccaggatggtctcgatctcctgacctcatgatctgcctgcctcggcctcccaagtgctgggattacaggcgtgagccactgcgcccggccgactggaaagtatttcaaagtagccagtgtaaacatgttcacagaactgaaggaaagcttgattagagaagtaaaggaaggtatgatgataacgttgcatcaaatagagaatatcaataaagagatatacattttttttgttgtttttgagagaatctcactctgtcacccaggctcgagtgcagtggtgtgatctcagctcactgcaacttctgcctcccaggttcaagcaattctcctgcctcagcctcccaagtagctgggactactggcacatgccaccacacccagctaattttttgtattttttttagtagagacggggtttcaccgtgttagccaggatggtctcgtctcctgacctcatgatccacccgcctcagccccccaaagtgctgggattataggcatgagccaccacacccagccaagccatacatttttttaaaaagaaccaaatgaaaattctggagttgaaaagtacaataactaaaatttaaaattcactagagaggctcaatagtagatttgaacagaagaaagaattggcaaacttgaagctagatcaaaagcgattatgtaagctgaagaacagagagaaaagagaaaaaagaaaaatgaaatagagcctcaaacaaatgtggaacaccattaagtacaccaacacacgtataatgggagcattaggaggagacagagagctgggtgcagtggctcacgcctgtaatgaggcaggcggatcatttgaggtcaaaactttgagaccagcctggccaacatggtgaatgaaaccccatctctaaaattagccaggcatggtggtgtgtgcctatagtcccagctattccggaggctgaggtgggagaatcacttgaacccaggaggtggaggttgcagtgagctgagattgtgccattgcagtccagcctgggcaacaagagtaagactccatctcaaaacaacaacaaaaaaagaaggcaggctgggcacggtggctcacacctgtaatcccagcactttgggaggcccaggcgggcggatcaccggaggtcgggagtttgagaccagcctgaccaacatggagaaactctgtctctactaaaaatacaaaattagcaggatatggtggcacatgcctgcagtcccagctgcttgggaagctgaggcaggagaatcctttgaacctgggaggcagaggttgcagtgagccaagacagtgccattgcactccaacctgggcaacaagagcgaaactccgtctcaaaaaaaaaaaaaaaaaagagctagagagagagaaaagaagaaaaaagaaagtctgaatatccaatactatcattacttttgttgttgttgagacagaatcttgctcttgttgcccaggctggagtgcaatggcacaatcctggctcactgcaacccccacctcccaggttcaagcaattctcctgcctcagcctcccaagtagctgggattacaggtgcctgacaccacacccagctaatttttgtatttttaatagagacagggtttcaccatgttggccaggctggtcttggacccctggcctcagactcccaaagtgctgggattacaggcgaaagccactgtgcccagcctcattacttattctgttgccccaatttttcaagtcttaaccattaggagctccttcaggttggctcctgtgttcattctttcatcaagcccccatccttttttgagcacttccttactcctgccccacaagatgctccagatttgacttatattttcccagtcctagtcctggaatcaactccaaggagtccttaatccttttattaaataatggtttttagaaaccaaaatctgggcacctggtttgctcactgctactaggatgttgttgattctaggccttctcagcaaacggagatagcaaacatgaataacataatccacatatatatacacatatctatatttctgtatctttccatctgtgtatatttaaaaacatgagtttatacagatacttctgtttctgatctaataccacagcattcatttaatcccctttccttatctgtaacttctttctccaacagtaagaaacctggttctcattatctacaatatagtttacttattcatgtataccagtatacacataatatagtttcagaattgctaacacatacttctaactagatgacagcatttatgttcagctctctttatctttagtttagttggttttttgttttgtttttgttttttgtgacaagctctctccctgtcatccaagctggagtgcagtggcacaagcttggctcactgcaacctcctcctcccagcttcaaacaatgctcctgcctcagcctccaaaacagctgggactacaggcacgtgccaccatgcccagctaatttttgtatttttagtagagacggggttcaccctgttagccaggctggtctcaaactcctgaccctcaggcgatccacccaatttaggcaatccacctgcctcagcctcctgaagtgctggcattacaggcatgagccaccacacccagccacatccagctagttttttaatcttttgtagagatggagtctcactttgttgcccaggctggtcttgacctcctgggctaaagtgatcctcctgtcttggcctcccaaagtgctgggattacaggtgtgagccactgcaccaggcccatctagagttttatagagccctgtcaaattactgttttccagagttacttggttttgttcttcacttccttcagtgtggttatattgttcatttgtaatacagtgagggtcatttgttagtgtttgtattccatgttaggtttcctcaacactgtgattgcttttaattttctgtctattgtaggggcatgtgaaacactgctacagttctaagagtcagaggtatacaaaaagatctactttgagaagtgtcatttttgtcctcattctcgcaaccctgacccctttccccctttcgttccatccctttgccactcactttcttttttgttttttttttttggagacggagtctcgctccgtcacccaggctggagcgtggtggcgcaatcttggcttactgcaacctccgcctcctgggttcaagtgattctcctgcctcagcctcccgagtagctgggactacaagcatgagccactatgctcagctaatttttgtatttttagtagagatggggtttcaccatgttggttggccagaatggtctcgatctcttgacctcgtgatccacccgcctcggcctcccaaagtgctgggattacaggcgtgagccaccacaaccggctccgagatatctttaagaatacttcaaggccctgctgaactcagtatgaaaactgcaccaatggacaaagttggacaaaggtatttggtaacaagccttctgaagcctgagattcagccctgttctcatcctagaattatacgtgccattctacaggactagaactacaaacaggggtcaggagaccaactcccaattctggttctgccatgaacatgctttataaccctaggggatctcctaaatttgtggattcaatttctcacctgaaaaatgaagaacttgaactctgtgatcacgaggttcctcccaaagccttccttctgtaggttttgtgtacattaccttagctatagttggaggcgtgccagggctatggagactcacctttacaacatacactctgaccaggagcttgatgggccggttctgtgggatcccccgggagatctggggctcagagaacaacactgcctctgattcagggtaaatgaggaaggagccctgagttggggggagacagaaaaagctctggtaagataattgtcctcctgaatccccacctgggctccctggttccgctttccttccccaaatgtaccttgaacttgcccacaaggtgtccagatccttcctcttctccacctccatcctggcccccttgccctcggtacagaggaaacacattcagccagtcttcaaagtggttaaattcttccttcagggacctgttgtagatctaaaaggcaaggacttcagcaacagcccgatgtccagaatccaaaggagactttcctcttcccagtacccagtcaccttcagggtggcaactgctttttttggggacacagtgcctttgacttcagcctcaccctggtcttggatctccccaaccatagaaatgaggttgaccccatctggaaacagcaaaaatgccccagtcagaaatatctgggtgggtaggggatgggcagatggaaccagagcaaaaagcccaatctgttacctgaatctccaggatcatccatttcatcttcatcaaagttgtgctgaaattaaagagcagatccagagattcttccccatccccttcaaccccttagtctacccccttttccaggagagttgggaaaccttcactcaagttcccactgtgtatgccacttgcatttttaaagctccaatttatcatccagcctgccctgtctagggcagtcaccaccagccacacgtggctactgagcagtcaaaacgtggctagtctgaattgcaatgtgctgtaagtggccaggcttggtggctcatgcctggaatcccaacactttgggagactgaggtgactacttgaggccaggagttcgagatcaggctgaacaacacagtgagaacctgtctctatgaaataaatgctttttaatttttatttatttatttttgagacagactcttgctgtgtagcccaggttggagtgtattggtgtgaacatggctcactgtagcctcaacctccgaggctcaagtgatcctcccacctcaacctcttgagtcgctggggccaccggcgtgtaccaccatgcacagctacttgttttcatttttagtagagatggtgtctcaccatgttccccagactgttctcaaactcctggcttcgagtgatcctcccacctcagactcccaaagtgctgggattaccggcatgaaacaccacacccaggaaaaaaaaagtttgtaattagctgagtgtagtggtatgtacttatggtcctagctactggggaggctgaggtgggaagatcacttgaacccaggagtttgagaccagtctggataacagataaagaccccatctctaaaaataaaaagaaaagaaagaaaaagatgtgcgataagtataaaataaaaaccggatttttaaatacttagtacaaaaaacaagaatgtaaaatatctcagaaattttatgattacttgttgaagttttttttttttttttttttttttttgagagacagagtttcactctgtcacccaggctggagcacagtctcggctcactgtaacctccacctcccaggttcaagcgattctcctgcctcagcctccagaatagctgggattaacaggtgcccagcaccacgcccggctaatttttgtatttttagtagagacggggtttcgccatgttggccaggctggtctcgaactcctgacctcaagtgatctgcctgcctcagcctcccaaagtgctgggattacaggcatgagccactgtgcccagccttgaaatggtattttgaatatattactaaaattaatttcacctgtttcgttttacttttttttttttttttttttttgagagggagtctcgttctgtcgcccaggctggagtgcagtggcgcaatctcggctcactgcaaggtccgcctcccaggttcacaccattctcctgcctcagcctcctgagtaggtgggactacaggcacccgccaccatgccccgctaatattttttgtatttttagtagagacggggtttcaccatgttagccaggatggtctcaatctcctgacctcgtgatccacccgccttggcctcccaaagcgctgggattacaggcgtgagccaccgcgcctggccccttctactttaatgtggctactacaaaagttaaaattacgtatgtggctcgtgttatgtcttttggacaacacagctctagataatggagttaataatccccagcttctagaattgtgaagaaaagaggactataatgaagagctctgaaaaactgtagagctccaccttcaatgagatcattcttgttttttgtttgttttttgagacggagtctcactgtcacccaggctgttgtgcaatggcatgatctcagctcacaggagcctctgcctctgggttcaagtgattctcctgcgtcagcctcctgagtagctgggactacaggtgcgcgccgccatgcctagctaagatatcattctttttaccatttacaccccagccccctccctgggacccttctctgcccccacctgcccctggagctcctgcagcgacgcatagtacttggacccccagtcgagctcctctggatctgggatgtcttcctccagcccagggccttgatttaggaggcctcctagtgggagcttcttcagaggaggctgaggaagagcagactttgtccctctaacccagcaccatcccaagtactgccagccccttcaccatctatctcctctaccccatcaccttcaggagctgtctggatatacccgcttcagccaagaagggatccagggacttctgtcctgggagggggaaaatggcagcatgaggagagtgggtaagtagaagtcagattccacaccccatcggagggccctctggagccacgtccaccaggaatcagaggggcttctgtctggtgtccctgaaggagaaggttcctaaccttgaggtcccttgggcatcatatcccctgtctcctccatctctccttcctcctcaggaggatcctcatgaccccgaaatgtgaatcgcagcatgtgggggacaatgtgggaacccacaaggactgtgtggccaaaggcccggcgctcaatcaccaagatgctgagtggaggctgcaagtaaggctgctccggcaagtcctgggggtggaagagaggagctgtgtctttgaagacctggggaacagggaaaggtagccacagagacaggtaggaaaaaaaatacatctaaacctgcattctaagcccagctctgccatagcctcactgtgtaatctctggtaaaccattgccttctcatcctgtttcctagctaaaaaagggacacaggccgggcgcagtgtctcatgcctgtaatcccagcacttggagaggccaaggtgggcagatcacaagttcaggagttcgagaccagcctggccaacgtagtgaaaccccatatctactaaaaatacaaaaattagctgggcgtggtggtgagcacctgtaatctcagctactcgggagactgaggcaggagaatcgcttgaaaacagaaggtggaggttgcagtgagccaaggtcacaccactgtactgcagtctgggcaacaacagcaaaactccatctcaaaaaaaaaaaaaaaaaaaaagggacacaatcctggattcaaaagactgttgtaaatatcaaatgacataatagaaacataagtactttggagcctacaaagtgctgtcagaagctgggcatggtggctcatgcctgtaaccccagcactttgggaggctgaggcaggcagactgctcaaactcaggagttcgagaccagcctgggcaacatggcaagacaccatctgtaccaaaaatacaaaaaaatagccgggcatagtggtgcgcacctgtggtcccagctactcaggaggttgaggtgggaggatcacttgagcccagggggcggaggttacagtgagccaagatttgcactccagccttggtgacagagcaagagaccctgtctaaaatatatatgtgtatatacacacacacacacacaaatatattttttggctgggcatggtggctgacacctgtaatcccagcactttgggaggccaaggcaggcagatcacttgaggtcaggagtttgagaccagcctggccaagatgatgaaatcctgtctctactaaaaatacaaaaaaattagctgggtgtggtaacgggtggctgtaatcccagctacttgggaagctgaggcagaagaatagcttgaacctgggaggcacaggttgcagtgagccgagatcgcgccactgcagcctaggcagcagagtgagactctgtcttaaaatatatattatggtttattttattttatggttaaaggccatatatatatatatataaaatatatatatataaaatatatataaaatatatatatataaaatatatatataatatatatatataaaatatatatatataatatatatatataaaatatatatatataaaatatatatatatataaaatatatatatatataaaatatatatatggaattccatatctatcaatggatcctaagggaaacaattttactactgtattggtgggtttattttatgtatttgtagatatatacatatatacacatatatatgacaattttagcacaaaagagaggaaaaatagagctataccacagaaaagtttgtatattttactggaattaaattagtattaatctgaagtagactgtgaaacagtagtatgtatattgtaatccctagagcaactactaagtaaaaatcagcaaattaaaatagtacactaataaatatcaaaatataataaatatctatttaacacaaaagaaagcagtaaaagaggaataataagtccacaagacatagaaaacagacagcaaaatggcagatgtaaattcagccaataatatcaacagcatcaaatgtgatcatattaaataccaatcaaaagtcagagattgttaactgcattaaaaaaaagagatgcgactccatgctgtctaagagatactctagattcaaagacacataaaggatgaagtataggaaaaaaatatatcatgcaaatagtaaccacagagagctggagtagttataccaccagagaaaatagactttaatacaaaaaatattactagagacaaacagatactttataatggtaaacaggtcaattcatctagaagatataacaattataaacatatatgcacctaacaacagagcctcaaaatacaaaaactaaaaagttatagaattaaagagagagatacacaattcattagtaatagctggagatttcaataccctattctcaataatggatagacagaaaataatcaaagaggcttgttcaagaggtctgaataacagtaacacctagagagcaccacaagtccatgaattaatccaggaatcagcaaactacagcccatagacagagtctggcctgctgtcagtttttgtaaatattcatttacatattatctatggctgttttcatgctacgatggcagagttgagtagttgcaacagactggatggctctcaaagcctaaaatatttactatttggcccattatagagagtttgctgacccttggatcatctaagataaccaggtagaaagtcaccatccactgccctctttcactattctgccccccttttcccctagcccgtggcctcaccactgtcagatgcctgacaagctcagtgaaattggggctctcacggtagctggccaggacctcagactccacaccttgcccagccacctccagtacaacctggggctgctccacctcgagcagatgcacacgaccaagtcccctaagaccccagaacagcacctggggtcagaaaatgggagattcaggggcctgcaccagacaaatgggcacccggatgttggggaacaagggggctttgagtgcctggtgatacctcaacacggaactccctgagcactgggcacacgttgggtggaagggacaggcgtccagagtggggctcaaccaggggtgccagatcctggggctccacctcactgggcactgagggctgtaggagggaaacagtcagagggcgaagaggaatcaggccaaaggaggaaaagcctaggtgtggggaggggatatggagaggtactggtgaaatgtaaatgcacaggaaccaaccaaggctggattggtggaagggagggggtctcgggaagcagcttcgtgcaggaagggagcagggtgtctgaggcatgcaggatggcccaacaaggtgaacctagcacatgaatacttgcaatgttccttggggtcaagtggtccaatgaggtgacctcaggacaaacctgcagtctttattctctggggaaaagagacctggaggctggtcctgggacatatccatgttttatattccctagggctggatggcctgatggactaacaagttgggctcacagcctgtgctagccacgccagggcatgctgacctcaagtcggccactgtagtctagttcaatgagttgaaaggcggcaatgagctctccggctgcccagggtcccttcctcagggggaagaactgcaactctgggcgttggtatgggtcctccatcagctttacccttggggcggccagtgccctgcccaggaacacgggggggccctagggggagcagggcagtgaagacaaaggggaagaggctcaggagccagggaaggtgggcatcaagggggaaactcctggccaggaacccagggagggcccaggccacactcacaaacttattgtggtcaaatacattgatgatcactaatggaggctcctcctgcaggtgctccctcctcccatccacgatcaactgctcaaataccaggagttcatcccacagagggctcagcgtctgctccaggaccttgggggccatacagagaagcgggtagcagcagatatcaggagaaggctcccaacatgcatgccatgcgaacacccctgctctgaaggaatactttaagtaaatgctcatcacaagaagagtgagatgtgaggaagacgaaagcatcttcagttggtgttgcagccagcccctcacagccctgcctccccattgcaattggcccctcagagtccaggcctaaagtcaaccccagaaaatgactcctcgccgctaagacctccagttctacatcacctgctaagttagggccatctagtaccccatcctgataccctgctctgcaaacccagagtgcgaggagaggggccttggggaaaagctcagacccaccctaacttgtctcctgggtcccttccacccacatgtcatcccagccctcacccgtgtggtctgacactgggtagagatgaggactcgagcaaaggggtccgagaggccactgtcatctgcagccaacacaccccgggcctggtacaagtgagcccggagttggaagtagctaaagtctggggtgaggggcaaggaaggtgtcatgtttgcccaggggaaccactgaagtcccctgactgagccccacaccttgggcagagagccaggtgggccttatacctgccctgcccaccctctgcactcaccgtcccggtgtaggctggagggcagcccggctgagggctcgggcagcaaatccgggggcagctcagaggtgcaggccttggcttgcttgcccaggcccagccgcaggaagagctccagcttggcacagacctcaccaggggctgccccgggtgcctgtgtgtgaagaaggcatgtcagggccccgatgcctcttctcatgaccccagctagacctagcaatcctgcttccccagggcacacctctactgcacatcgccacaccatgccaaactcccagtccactccctacctgcccagccttaccctcttcctaccctccaccctacgccatgaccctcacactcttactccctatacctcttgccctaacactgccacttcccgtaccccactccccagacccctaactacactctgagctctgctctcccacctttgtcccctccaccccctacacgtttacattccccatccccaaccccaagggtcacggcttctccctcctagggacccttttcagttatcttttccagggacacctcatttagaaatctttggcccacaaaccagctacacttttttttttttttttttttttttttaagatggagtctccctctgttgccagtctggagtgcagtggcgtgatctctgctcactgcaaactctacctcctgtgttcaagagattctcctgcctcagcctccctagtcgctggaattacaggtatacaccaccacacctggctaatttttgtatttttagtagagacggggtttcaccatgttggccaggctgctctccaactcctgacctcaggtgatccgcgtgcctcagcctccccaagtgctgggattacaggcatgagccaccactcccggccagaccagccacacttgtaaggggtgagtcacactctctcgtttttggtaccctgcctatctgtcagggcctagtcagcaaaatggcccatgcagtcccagagctagggaagatttggggtttatctgatttcaaagctgccccaggcaaaggcacaatccctttctggtgttttggacaattggaaagtgttcaggggcccctagctgggaagcacaggcctctacccaaggcctatcctacccttgccctataagctccactccacttctcccggcccctcacccgtgggtcccctcaccgtgagcattagactctggatcttcccacagtctcggccccgttcctcctcaaccacagagaacagcacatcctgggcagggatccgggcccaggccacacggcgctgcccgctgagcatccagaccagcacatcggggaggggtggctggggctgcgggtggataactggtcacggaggtggatctggagccgacctctcctgctctcacagcttgaactgaacggaccaaatagccactccagcttctatctccccgagacagggtctcactctgtcgcccaggcatgagtgcagtgacactatcatggctcactgcagcttgaccacccaggttcaagcattcctcccacctcagcctctcaaggagctaggactacaggcacgtgtcaccatgcctggctaattttttactttttgtagagatggggtttggccacgttgcgcaggctggtctcgaactcctgggcttaagagatcctcctgccttggcctcccaaagtgctgggatcacaggcatgagctaccacacttggcttcttttttttaattgtggaaaaatacttataaaattgaccatcatcctaaccatttttaaatgtacggttcaggggcatgaaatatattcacaatgccaggcacggtggctcacgcctgtaatcccagcacttttggaggctgaggtgggcggatcatgaggtcaggagatcgagaccatcctggctaacatggtgaaaccccctctctactaaaaatacaaaaaattagcctggcgtggtggcggacgcctgtagtcccagctacttgggaggctgaggcaggagaatggcatgacccgggaggcggagcttgcagtgagccgagatcgctccactgcactccagactgggtgacagagaaagactccgtctcaaaaaaaaaaaaaggaaagaaaaaaaaaagaaatatattcacgttattatgcaaccatccccatcattcatccccagaacatttttcatcttgcagaacagaaactctgctcattaaaccatacctctccattcactgctctccatcccagcccctggcagccaccattcttctttctgtgtttggatttgactacaacaagccctccatatgagtggaatcatatagtgcgtgcccttgtgcctggcccagttcactaggcataatgtcctcaaggctcatgcacgtggtagctggtgccaaccttgtctcttcacctttccctcctccccagtcttatcttccccaatgtgcacagtgtgcacatgtggtgcccatcacatcagccaaatacctgggctggtgacactcttctccaacatccaatcacccattcctggcagtttcccccttctctccctttctccctgccccacttcaagaccatctgctttttttttctgttgccgaggctggaatgcagtggcacaatcatagcttactgcaggctcaacatcctgggcccaagtgatcctcccacctcagcctcctgagtctctggggactataggcacacaccaccatgccttgcgatgttttcatttttaaatttttttgtagagatagggtctcactatgttgtccaggctggtctcaaactactggacttaagcaatcctcccacctcagcctcccaaagtggtgggattacaggtgcgagccaccatgcccagccaaaagaccacccactcttggctagacaattgtgacaggctcctaagcagtcttcctgccttgagtcctcccttcctacccactctgccatggctggctggcttctccccatcctctgggtgtcagctgcaatgttgtctttgcagataagacttgcctgaccaccttacccaagcaggttctcctccaccccctcagcctctgtaacctctttcttaccaattcctatagatcataattatttttcatattcatttacagatgtatagtctgtcttcctaggacattagcctcaaaagggcaaggaatatggcaggggctgacccccagggcctaatacagagcctggcacacaggaggacttgaaatatcattgagaggccaggcgtggtggctgaggctgggcatagtggctcatgcctgtaatctcagcactttgggaggctgaggcgggtggatcacctgagatcaggagtttgagaccagcctggccaacatggtgaaccccatctttactaaaaatacagaagagtaggcaggcaaggtggcacgcgcctgtaatcccagctacttgggaggctgaggcaggggaatcacttgaactcaggaggcgaaagttgtagtgagttgagatcacaccattgcattccagcccaggcagcaagggcaaaactccatctcaaaacaaaaaaaaacaaaaaaaaaaccaagaatattcatagcagctttattcatactagctaaaaacatgaaacagcacagctgtccatcaatatgagaatgaataaacaaactgtgatatatttatacaatgggaaattgctcaacaataaaaagaaagaaactagatatctgcaacaacttggacgcatcttacaacagcctctcacaagagaatacagtccttcctcattatttgtgaattctgtatttgcaaatttgcgtactagctaaaatttgtaacccccaaatcaatacccctggtgcttttgtaatcacatgagtatgggcaaagagtcaaaaactttgaacaggtcaggcatggtggctcgtacctgtaaccccagcactttgggaggccaaggtgggaggatcacttgagcttaggggtccaagagcagcctgggcgacaaagtgagacctcatctttattaaaaaaaaaaaaattaaaaaaaattttttttgagactaagtctcgctctgtcacccaggctggagtgcaatggtgcaatctcggctcactgcaacctctgcctcctaggttcaagcaattctcctgcctcagcctcctgagtagctgggactataggcatgtgccactatgcccaactaatttttgtatttttagtagagatggggtttcaccatgctggccaggctggtctcaaactcctcacctcgggtgatcctcctgcctcagcctcccaaagtgctgggattacaggcatgagctaccgcacccatcctctactaaaaatttttaacccttctttggttgaagccgcagaaacaagatgacaaaggaaacgtcatcgtttggaaagcatcgcgataagacacacactttgtgccgccactgtggctctatggcctgccaacttcagaagtcgacctgtggcaaacgtggctaccccgccaagcactagaggaagtataactggctaaaagacaaaataccactgggactgatcgaatgaggcacctaaaaattgtatactgcagattcaggcatggattctgtgaaggaacaacacctaaacccaagagggtacctgttgcagcatccagttcatcttaagaatttcaacaattggccgggtgcggtggctcatgcctgtaatcctagcactttaggagcccgaggtgagtggatcacgaggtcaggagttcgagaatagcttgatcaacatggtaaaaccccgtctctactaaaaatacaaaaataagccgggcgtggtggcgctcgcctgtaatcccagctactcaggtggctgaggcaggagaatcacttgaacctgggaggcggaggttagagtgagccgagatcgagccactacactccagcctgggcgacagagcaagactctgtctcaaaaaaaaaaaaaaagaaaagaaaaaaaaaaaattcaacgagtcatgcaaaaagtgttctggtttattaaaatacaaaaagaaattttttaacctatttcctgtttgccttgagaatactcttgcctgtaatcctaatgtaacatcatatatacttctgttacattaggattagagacaagttctgtttagaaataactccaagtaaggtttttatattttattttcatattgaaaatcagtcataatttcttcagcctcaaagaatgagtttatgtaaaattaaatgagtgctggcagtgagctgcactttttttctctaaacgggaaatgggtttaaattttttttttttttttttttttttttttttttttttttttgagatggaatcttgcagtcacccaggctggaggaatgcagcggcacaatctcagctcactgaaacctccatctcctgcattcaagcaattctctggcttcggcttcctgagtagctgggattacagatgcataccaccacacacacccagctttttgtgtttttaatagagagggggtttcaccttgttggccaggctggtcttgaattcctgacctcaagtgacccgcctgcctcggcctcccaaagtgctgggattacaggcgtgagccaccacacttgagacttagatttaaaaaaaaagtttgaagggccctgagttggaataaagcaatactctgcctttgtgagctctgatactgtaagcattttgtttttgtttttgttttttgagacagagtctcattctgtcacccaggctgaagtgcagtggcacaatctcagctcactgcaacctctgccttctgggttcaagtgattctcctgcctcagcttccagagaagctgggactgcaggcactggccaccacacctggctaattttttatatttttagtagagatggggtttcgccgtgctggccagcctggtctcaaactcctgacctcaggtgattccacccacctcggcctcccaaagtgctgggattacaggcgtgagccactgcaatggccaacaatatattatattaaagaaagtatctttaaacaaacacacataaaacaaggttttgtactgatcagttgacaaaaaaaatgtgaccatcgcccactagaaacctaaccctgtatttctctgggggcagtgattcagtatttgctaattcagtgtttgcagcaactttatagaccaccaataacaagaactgactatacatatggcatgattgcattgtattaaaatctagtacaggcaaaactataatgaaaaaaatcaaaatatattgaaaaaatcagtagttatctctatgggggtggatggagactgactgggaaggaacataaaggaacaactctggggtgaaagtcatattctagatcttgatagggacttgggttacacagatatatgtatttgccaaaattcagcaaatgtgtgttaagatttgtacacttggccagacatggtgactcatgcctgtaatcccagcactttgggaggccgaggtggccagatcgcttgagtccaggagttcaagactagcctggccaacatggcgcaaccccatctctactaaaaatacaaaaattagcaggcatggtggcgcatgcctatactcccagctactcaggaggctgaggcagaagaatcacttgagcctggaggcagaagttgcagtgagctgagatcttgccactgcactccagcctaagtgacagagtgagactctgtcttaaaaatatatatgtatttgtacacttcattatatgtaaattgtacatcagaggaaaacactgtaatttttttttttaaatcagtggagggccgggcgtggtggctctcgcttgtaagcccagcactttgggaggccaaggcaggtagatcacgaggtcaggagttcgagacaagcctggccaacaaaatgaaaccccgtctttactgaaaccccgtctttactaaaatacttaaattatctgggcatggtggcaggcacctgtaatcccagctactcaggaagctgaggcaggagaatctcttgaacccaggaggcagaggttgcagtgagccgagattgcgccactgcactccagcctgggcgacagagctagactctatctcaaaaaaataaaaaataataaaaaaataaaaatcagtggaggggtccactattagtttggatgtagaaagactcactcccggcctggcacagtggctcacatctgtaatcccagcactttgggaggccgaggtgggcagatcacctgaggtcaggagtttgagaccaacctgaccaacatggtgaaactccatctctactaaaaatacaaaaattaaccaggtatggtggcacatgcccgtaatcccagctactagtgaaactgaggcaggagaatcgcttgaacctgggaggcagtgagccaagattgcgccaccacactccagcctgggcgacagagccagactgtgtctcaacaacaacaaaaagacttataccctaacaaccaaaataatccaaataaattgtaaaattatacacacccacaattatttttttggatataggatctcgctttcacccaggctggagtgcagtggcacaattatggcttactgtagcctcgaaccctgaggcccaagcagtcctcccgcctcagcctcccaagtagttgggactacaggagcttgccaccacgcctcgttagttttattttttgtacagatgggggtctccctatgttgcccagactaaaaatcgtattttaaaaaacacatcagagaagtggggattcaaagaaacctatatcaactaaactccagaaaatgatgagttcttcataatcaaggagagacctccagctgctactcccacctctggcagaacagcagtagtaaaaaggaacatcagaagtggggacaaggagaaagtatccacttttaagagacttttaatgactatgtgtgaggtagcataccagatgagaatcccagggaccacagccacaaaatatgtctttccgtacctccgaactctttcctatggatcctcgcctagagctaaggggcggtatgcaaaaagctgggaacagggaaggagagctgagatctttctgaggtatgtaaagtttcttgaaagtgcagagtaggccgggcactgtggctgacacttctaatcccagcactttgggaggccgaggcaggtggatctcttgagatcaagagttcgagaccagcctgacgaacatggtgaaactccatctctagtaaaaaaaaaaaaaaaaaaaaatacaaaattagccaggcatagtggcacatgcctgtaatcccagctacttgggaggctgaggcaggagaattgcttgaacccaggaagtggagattgcagtgagctgagatcatgccattccactccagcctgggcaacaagaacaaaactctgtctcaaaaaaaaaaaaaaaaaaaaaaagcacaaagtaactgcccttagaaggaggtggtagggaagagaatttaaaaacccagaagtggtcctctgggatttcatcttttgaaggctgagggttaggtaggagggctgagagaaacctcccccactaggctttcagctatcagatgctacaggctcagctggagagccaagagaacccttctgatgcattctagacttttacaacgtaaagtggagaccctccaaaggccagaggagggaaagcaggactaacaaggcacagaggaaaggaagcagactcaaaaagcacagagaatgccccagcaacccaaacacctggttggtggtttgtaaagcagggagagcttacccagagttggagaattggcagtttgggtgtgaacaagaaacagatttctggaatcttgccagttctcagttctaagcctggatgaaaggacaatcgtgatccttcaaaaaaacatttgaagcccaaagtgaactgaaccaaaccaaattcacaactaagcccatttcaaatacaaagcataatgacttggtcctcactctctagagtaaggcctagtgtaagaagagaaatgccatttcctggacatatatattattttagtcactaatgttttatacaaatatccaggcatatgataaaaaaaattacaggacggagttaaagcaaaactcatggtcaagaggaaataatcaatagaagtagatgcatagataacccagatgttggaattattagataagcatattaaaataactgtgatagaaatctaaatgatctagtgaggaaagtacacaagaattaaaagatgggtgatttcagcaaacagttgaaaactggaaccaaaaggaaataatagaaattttaaatatatcaggcaaacagttctacaatagttggagtcttcagtacaccacttacaatagcagatggaacatctatacagaatattattaaggaaatagacttaaaacaacactaaccaactatacctagaagacacatacaaaatactccatcataacagcagagtacacattcttctcaagcactcacggaacattcttcaggatacatcatatgttagatcacaaaacagtaaatttaaaaagactaggctggccgggcatggtggcttacacctgtaatcaggcagagattgcagtgagccaagattgtgccactgcactccagcctggtgacagagagagactgcgtctcaaaaaaataaaaaaaataaaataaaaaataaaaaaagacacaaatacctaaaatcagaaatgaaaggaaggacattactagcaaccttatggaaataaaaagattgtaagagaataccatgaacaagtataaaataacaaattggattatctaagatgaagttataaaattcctggaaatacaaattatctaaactgactcaagaagaaatagaaaatctgaacaaatctataacaattaaagagattgactcagcagtcaaaaacttcccaaaaaaagtcaagaccagatgccttcactggtgaattctaccaaacacttgaagaagaattaacgccaatccttttcaaactcttccaaaaaatagaagagggaggaacacttcgtaactcattctatgaggccagctttaccttgatatcaaagatagataaatcacaagaaaagacatcaaatcattacatgccgggcgtggtgacttaggcctgtaatcccagcgttttgggaggccgaggcatggaggatcccttgagccccaggagttcacgaccagcctgggtaacacaggaagaccccatctctactttttaagtactttttttttaaatcaaaaaagaaaaaagaaaattacaaaacaatatcccttataaatacacagatgcaaaagtcctgaagaaaatccaatgacgtatttaaaaaatggatatacaccattgataaaaggaattcatctcatgaatgcaaggatagtacaacctaaggaaatcaatcagtgtaatacatcacagtaacagaacaaaaaagaaaaaaacatgatcatcttaatagacacagaaaaaaagttcgataaaatctaacaccctttcacaataaaaacgcaaaactaggaatggaagagaacttcctcaacctgataaagggcatttatgaaaaacactgctaacatcaaacttaataaataatgaaagctttccccctagaatcagaaacaaagcaagtgaaaattacaactttggctagttgtggtggctcacacctgtaatcccagcactttgggatgctgaggcaggagaatcacttgaacccaggaggcagaataaaattacaatttcagaaaaagtatgtgtcttgtatctgccattgtgagcttgacagcttgccaacactcgaagatttttgtgactggacatggcagctcacacctgtaatcccaacactttggaaggccaaggcaggaggactgcttgagctcaggagtttgagaccagcctggtcaacacagcaagaccccatctccatttttttttttttttttttttttgagatagagtctctgtcacccaggctggagtgcagtggtgtaatctgagacctgtcccgagaccaaaaagtttgagaaccactgccatagaaaagcaccaggacatgtaccaaaatggtctcggaagcattgtttctaatcacaacccattgggaacatctcacatacccatcagcagcacaatatgttatatatatatatatatatatatatatatatatgtatgtatatatttagtgcttcagacaagggaggtcatgctcaaggcagcctactctcaaatcttcatccaaagaaatcctgaatgttccctgggtctctgctggattctagaactcttgtcctcacccttagctactgcaaatgaatcttggtcctatgcccacagcaattagtcccagccctggcatcattccaaaggaaaaatgttaaatcacacctgcccgaggcctctggaatggttcaaaagcttagggaaaagggtgtacagggtaggaaagtggggtgagtgaggcattacctcctcagccagaaagcgcagttttgccaggagcttcttggccagtgccaccttcttttgcacattgcgccgtctcaggccgcgtagaagtcgcagtccttgcttagccaaaaggttctgggagggcaaaaagacagcatgagcggaaggccccagctaggcgcccctgagtcccttcccgaggccgtaccaggctgtgcaccaggagtttccctcggcatcgatccagggcattgggccgggtcatcgtcctgcgctcggcaccgtggcaaaactgtctgcagtgagcagggatgtgcacagcagacaggaatcaaaggaaaggagaaggacagtgaccttggggccacttgctctgagctgacctcccacccccagcctccctcatagccctctcagtcttgggctctgaagaggcaccctttctcctgcaaagctggcctatctctatttggaccactcccaaaaatcattaaggccagccttgctcttgagctccagagctcgctaatacttaaccacctactaccctggctaccccaggtgtggcccatggaccaacagcactggtatcacctgcaggctatttaaaactgtaggacctcagccccaccccaggccctgctgaatcagaagctgcgtttatgccctcggggattcctaagcacattgaagcctcagacgtctccaccagcttggctaacgtatagcttgaacattacatgcccaagccaaatgcatactttccaatgatcccccccgcaaaacaaaacaaaacaaaacaaaaaccctatttcacctcagaactttcgagtcatctctcactgctctttctctcttattccacatcaattcatcagcaaattctttatgctctaccttcaaaaaatatccagaatctggccaggtgtggtggctcaggcctgtaatccccgcactttgggaggccgaggcggtgaatcacttgaggtcaggagttcgagaccagcctggccaaaatggtgaaacaactgtgtctactgacgctgaaaggttgagcatggtgagaacagaaaagtgaccacctacagcctcctacctcactgcctctcctgatcagggtccttggctgagtccctgcttcctccctgcctctaaatgctggaacgctccaggttctcagatttctcttttctgtgctctgttaatgctgttatccagctccatctacataatgatagttcccaaattgacatttccagcctagaattctccccagaactcaactcatatagctaactgcctaccacacatgtccacttacaattcaataagaatttcacagttaacatgtccaaaactgagctcctactatctgccttccctcagatcccacctcatccctgcttccatcagaccttctcctttgttttctgttgaaaacagatttttttcttttttccaaaaaaagaagattttggcttgcataactatgcagttggtgcagccttaaactcctggactcaagccatcctcccatctcagcctcctgagtagctgggactacaggtgtgcaccaccacacccagctaacttttgtatttttcatagagacaaggtcttcctatattgttcaggttggtttcaaacccctgggctcaattgatcctcccaccttggcctcccaaagtgctgggattccaggtgtgagccaccatgcccagcccacaagccaaaatcttagcaagtcctgaggtatcacccccaattccaaattttctctggaatccattcacagcactccatctccactgcaaccatcccctagatcagttcatcgccacctgtcacgtggattatcacaatagcccctttactaatctccctgcttcctcccccactgatcccttttaaggatctatgtgttagagtgtatctttttccttttcaaaacattcactgcccctccccccccatttcactcagagaagaagccaaagtcattaaaatggcttgtgaggctcccacaggatctgtccctccccaccatcatcctccttcccctggcctcctccagcctcttctactatgtcacactgctgcagtcacactggttctgtgctcctcctcaaacactccaggcatgctgtcccctccacctggaacaccattacaggcaggctttctcctccagcttcatgtcaccttcacggtggcctcccctccacaccctttctgaaattgcagtacctctttctaatgcttccttgcttcgcgttctttcttaacacttatcctacttagtatttttctatctgtttacatgcttatttcacatgtctccacccttccccaacctctacacccaaatgtaagcttcagggtttttttttaaagtcagggtcccattctgtcacccagactggagtgcagtggcgcaatcatggttcactgcagccttgaactcctgggctcaagatcttcccacttcagcctcccacaagtagctgggactacaggcatcagccattgtgcctggccaacttcagggatttttgtgggcaggaatgctttttcactgatattcctgtgcctaaaacagtgtctggcatagtaagtgccataaatagttatcaaataaagaacccttttgagaagaggatctgaaaatcacttaagtacctggagcaggtaatggaattcagggcagtagtgaaggtcaaagatggaagtaactagaacatgttttttttttgttttcttgtttgtttgtttttgagacgtagtcttgctcagtcacccaggctggagtgcagtggcgcaatcttggctcactgcaacctccacctgccaggttcaagtgactctcctgcctcagcctcccaagtagctgggaggtacccaccattatgcccggctaatttttgtatttttttggtagagactgggtttcgccatgttggccagtctggtcttgaactcctgacctcaaatgatctgcccgcctcagactccaaaagtgctgggattacgggtgtgagccaccgcacctggccgaacatgtttatgtggttacagcaatgacctggtaactagggaccaatcaatgatgaaggggagaaaattgacaattacagaactaattcctccagtgatgaaatccagatcacagctgtggtcactggagcaggaaaggaggagagcagatggatgcagaagccggcaaggaggtagactgggtgtgggaaggtgattagcaggaacaagtgtgaaagaaaggaggcgaggtttgaagagacacgggataagcctctaggagcgtgggaaagggaactcatggagatggaaaacagctgaggtgccagagaatcaggggaagcctaacccccaataatctcatcagctccctggataggaataattgtcttctcatttttctgtaaggtgctgagcaaatgcagctgcaagctgcccttgggtccagacagccaccgagagtctcccttgccctggagttggcccaagtacaggcagcagtaggagtggctctcagctcacctgctcccagccaccagtacttccagtgcctgcttgagctgtgcacaggcgccaggccccggcttgcgctgcagtctctcaacctcctgcagcccctggtcctgtgcaacgtgggagagggtcagagtcttgagggtccctgactcagacctcttgtagaccacacccccacccaaggccccacccactcacgaccacacctcttggcctgcccttctttggctccatcaggttgatggctccatctttctagcccgctactggctccaccaaatgtgcggccccaccatccgtacctctacccatctccttcatccagtcccttcctgggtccaccaattctgaaactctgtcctcccacaactcctggcatcctcggttcgcccagaagctgtgctctttggcccttgcccccctggccttgcaccagcaaggtgctggctctctagtgcctgcccattagccccactgcagagcttccttcaaaggctgcagtgtcctaggcgtccctacggcccggtctctccctgtgggcgccagccttgcccttaccagcctctcggccactttgcgcacgcagttgctgctctgcaggcgccaggtgtggtcctcccagcaactccacacatgcatgcatggcttgcagtgacagaggggcaagcagaagtatggcctggcagatggagaggaggcttcgcgggcattctgggttcctggagacctcccaaacccccccttccagccaccggcagcactcacccactgccgtccatgggctcaggccgctgagcatgggtccccagttcttcctcctctttctcctcctctggcctggctcccagcagaggctgagcctccacggctgcaccctcagttccctccccagccctggaccctcggcccaattgctcctccagacggcctgcgcgacctgccccagagcagcaagggtcagtgggcgccaggctgagggctggaaccccccctcaaccacctctgcctcaacagaagtcagaacctgccccttactgaaagtcaacaccccttccagggttctaaggtctgaaatggcactcaggggttcggctaggccacacaccaatggagatctcgaagctgatgggctgggaggccacggtggggtcgatcatggtggcctcgaagagcacaccgaaaagcaggaaatcttcacagggcgccaggacattctgggggaggccatcaggctggagtcagcacctactctcccagggaacagcctggactatgcttggccgcattgcccacagaaagaagtgcgaccaaggcttggaagtcactgcaggtttcttactccctctccctcctcccggccccagcattggccctgggtatgggtcctctctcccacaacatgtgtgcatataccagagcccatgtgggcacacacctcactcttcgcccaggcccccaaattgagacccctgtcgtggtgtttaatgcctgagagtggattccaccttccagagctgaggtgaccccgccccctttgctaccccccagcccccacctctggcagcggcagcagctcctccacctccacctccatggcacgggggatctcaggcccctcggcaccggggctggcgtccaagtgctgcggaaccgcctttggggtctgatcccttctggctttctttttcttctttcgggtgagccgggacaacgtggacccctgctgggcctggggaggctcaggttcagctctcccttccaacacctgcatggacacagccagcagaaggcggccgcggaaccaaatgccttggccaacgccttcgttgagaccttgaagactatcccggagccccgcgccggggggcgagccatagaggggcacccaggccgggccgaaggtagggttaaaccccgctgtggggaacaagagaagcgtgttggaggggagcgtggggagggcgagtgctggtaaatctctgcacctcaccctgatctcctccaagtattcgggggtgagggcaggggaggggggctaagccgctctgaaacggaagaagttggccagcagctgcggacgcgccgctgtggaacacgacctggggcgcctccaaaacagctcagcgccccaaggagctggaaatcgcgggagcccggcctcgggggacgcagcctgagccctgggggcggggtcgggattggggcggagctacgggcgatcggccaggcctgggggtcggggaaaggagtggaccggcagtgtcagcgtgtgcacagctgtagaagggtgggactgggctggttactggacaggcggttgtggtcagaattttgccaacggagccaaaccgatggtggggttcacagtctgggggcggcttgaagcagtttgttttgcgggcggaccagccctcctaggcggagcggggtcgcgaggatggggcttgcggttgggaatgggccctatggagccctatggaccgaggcgagtgaggccagatttgccgcggccagaagcgctcacccgcgcggcccggatgggagatccgcctcaggtccggcacgtgcgtagcgagtgccgcgtcgaccaggggcgcgtcgtcccgcagctgcaggcggaggctgcgcgtcagcggcgggaagagctccacgaagctcagctgctcgttccattcgggcgccgccgcctcggcgctcaccgacgtctcgccctgaaggtggcgttaaagacaggagaagggagatcagcgcggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctggggccgggggtagcattggagggggcaggtccccgcgcgccctcacggacaaggtgaccttaatgaaacccttggtcccggcgcgggtgtctcggggatcatgcagcggaacccatctttggtagaactggccatctaagggcgaaggggcgagccaggggtaaggggcgaccggcgggacgcacagggtggccgtgaggctatcggagtgacggacaatggccagggcttctctggctcagcagggaggggcggaagtgccaagagttcagcctccgccagagatggccctctccgaagtgagtgtataggggtccatgcggagtcactgcagggtcaatctctagggcccttgtccgtgcagagtctcaataaggggacgattccatacctggctggtccaagatgatgcccaggtccatcctgaaggtgcctatccgggtggccataaaggggagggtctgcgaatggaaagccttgggggaaggtggtgttagtcctgcagctttctcatccccccttctctgaaggacactggtcacccctaccccactcaccgtgatctccagcagcaagtcttggagacgaagccgcgtgtcatgaaattcgaacaagaagtactgaattgaagtggggatgagaggtcagatgtgaagggctcctgccagcttacccaggtctcttgctcagaagaccctccttcccccacccccaaccctctcactgcaagcttttcctggatcagcaaccccccaaccccaacccataggcccagcatctggctccatttccacctaggcctcacccgctccgggaatagttctcacatcaacccctcccattctgtcaggctcgccctcttctgtggtggcacccacctcattgtagaaggggcaactggtcccacgctgtgtggcggtcacacggcgctgcccccccacttgcacggccacataggggttaatgttgactcccaccagtttctgggcttccagcacagtgactcccacctgagaggtacagaaggatgaggaaaggaagccagacctgcctgggtggagggaaagaacatgcgtgccagaagaggtagtacttccaagggttaggccctggaaaaagagtagtacctggaagtcttgagctctggacacctggaagggatccccatgggccagggccctggcgcggctggagagaagcttaaggttagcactcacttggtccctcccctgcacacgcacacgcgcgcacacacacacacacacttgcttggtgctgggaatgatgttttctctccctctgaatttttggattccaggtccttcaggtcatgtcttgctgcctccatctcaaccctgcacccacaatttgactcattcctggagcccgaaaccattcattcatgcaacagaggtttattgagtacctactatgagctaacactgtcccaagcactgggacgctgtagtgaagagacaaatcttgccctcatcaagctttcatcccctgcatgtgtgtgagccactgtaactatgtgtatgaacatggcagtgtctatgcctatgagcaagtgactggagaatccacccttcccacaccccctgggactgtgtgtttgtgagggcagatgggtgtgggagcaggtgtgccgtgggtacaagttacctcttgagggggctgaacataacaccagaaagttccacgtcaggctcatcatccaggtcctgctccagctcaagctccagctcattctcttcatcgtcctgctggcctagacttcgagctagcctgcggcctagagccactgcccgccgctccagctgggcctccccaggcctgataggaaagaccctcaagggacatgcctggaacccatcacccatctccaggcaatcccttgacttcctggagccttggactgacccctgacccttgaactgatcccactgatcctaggaccagttattgaccttgtggctgacttcactgatcccaggacagactcttaaccctgggacatttctaattccagaactgacctctgattctaggactgacctctgaccctggaactgattcagttctgacccaagaccctggggctgcccccatatcactggctcctaactccaagactgactcagtgactccaggtcatccccacatacttactccagttcctggaagcccacattggggatgattaactcgaagctggggaataataaatgaaaggactaagaggaacattcctaactacagagcggcacctgctcagcacacgtccaagggtcactgaatcggcagatccagagtggaaccgggcactacttctccctttccagggtctgcctgggctgggaccaccaggtcttgcttcagttgctgaggggattacctgtcctggatgggtgccccaaagtcctcctctgaccaggctccagtagcgccctctgggggctggtacttcaggtcaagctccacctggatctgaaaccagatacagtatcccctagggccccccatctaactgccctgggtctaagagaggcccaaggacaatgccagtgccttttactacaggcggcagagatctttctggccagcatccgtggtgccttgtggttcctctctgatcattaataatgtagactactcataacctattaagaactaagtaactaggcaagtttcctcgttatttttttctttctttttttttttttttttttttttttttttagtattgatgaggtcttattatgtaccttgcccaggttggtcttgagctcctgagctcaaatgatccttctgctttagcttcccaaagtgctgggattacaggcatgagccattgtgcccagccgcaagttacctcttgaggcccaacaggattccaaaattgtctcatttttgttggaaatcccttacggtggccttcactactctgcctggtctggccccaccaacctttccagctccatctcactccaggcaccccagctgtgctccttcaaggcgctggacttttgcatatgccttttcctctgcctggaacattctctcctcccagttaacatctgttatccttcaagtctaagttcaggtactatttcctcagggaaccttctctggcccccaagtagatcatactcccctgtggtaccctctcccagcccctaccagctttcttctaacacctgccagttccagtttcacacttacttgtgtgaatatttgtttaatgtttgcctcccttccaagggtgtgaatctttatctggttttgctcaccacggaatcctcattgctcagctcagcatttggcttatcataagagctcaacaaatgatgacggactgaacaaaagaactccacattatataaatgagaaaatagcttccaggccaggtgcggtggctcatgcctgtaatcccagcactttgggaggccgagggtagatcacaaggttaggagttcgagaccaacctggccaagatggtgaaacccagtttctcctgaaaataaaaaaattagctgggtgtggtggcgggcgcctgtagtcccagctacttgggaggctgaggcaggagaatcacttaaacctgggaggtggaggttgcactgagccgagattgagccactgcattccagcctgggtgacagagcaagattccgtctcaaaacaacaacaaaaaaagaaaacagctaccaaatgctaaagaacgtgtacaagttcccagacgggaaatggcagatctgagatttgaagttaggtccatgtctactaggctatgagcccttccatgaaacaccaggaaaatccagccaggttcatctttgtctcccaaaagaattgattgctgaaaggaatcctggctggaggccttgttaccactcctctctgggtcttaggttttcccctgtgagaaatggaaccctttatctagaggtacttaagggtggcagcctgggggccagaggggctcaccggggacacttgaagattctcatccactagggcttcccgtagcaccaaatgcccagcattctgtagctgctgcagggagatcaccagggtccctagaggcctaggggagtggcatagagcaaaagagtgacccaagagaatggctctaagtcacccccagcccaacctgcatccctgtctccccaggcctactcacctaaggctgaatacacggctgcagttgaccacctgcacagacagacactccccagccagtggagccccatagtggggccatcggaacagctggggacaggaggaagcttgtgacacccatgctgtgctgaccctaaactccaatccaaagcccattcttggctgggcacagtggctcacgcctgtaatcccagcaccttgggaggccaaggcaggcagatcacttgagatcaggagttcaagaccagcctgaccaacatggtaaaaccccttctctactaaaaatacaaaaattagccaggtgtggtggtacatgtctgtaatcccagctactcaggaggctgaggcaggagactcgcttgaacttgggaggtgaagtttccagtgagctgagattgtgccattgcactccagcctgagtgacagagtgaggccctgtctcaaaaaaaaaagaaaaaaaaagaaaaaaaaaaaccctattcctaaccctcagacaggagccaatcctccagacttagagctaactttaggactaacatccccaaacctggaagggatccctgcacatgggtttgaatctgagtgagggctgatctgggactaactagtgatcaagaatgaattcccccagtcttgcaactaatttgttccaatctgggtctgatctctcaggcctcagactgaccccacctcccaagactatacttccccaaacccaggaatgagcccctgaaccccaggttggacttggatgggagacagatcaggaaccaactgtactgacctcaccgatatctgcttctggaccacagtgaatttttcttgttttctgggtaaagcctgctcagaactgaaactagtcatatatcagcccctccccccacacacacaaaaataatttgcttcccccactcttggcccagtgtcaagtccctcctggattcacccttaaagaaaggtagacaatgggaaggaaagaggcagagggttggagataccagtgtgggtagagaaaagaaatgggctgtagagatgggaaggcattgggtcaagggcccccagtttcaaatatccttagggcgcccctgcaagcctcacctcgaaaggtgagcttcacttgtcggtcgtgggtgccggtcagccctgttagtcgttgcacgcgttaccgtcagagccatggtcccagtggcactggcacttcctctgcccgtctgcccttctgcccaccagcccgcccacctgaatcgcctctgactcactggactcacccagcaggtttagcaatccctaccctttagtcaaacacacagggagcaggcctgggggtcatgggtggggagggaggagaggaccgagggataggggtaaggtcctggaggtcaattcagccctccctgcctccaccagctgcaagctggcaggactgcctcagcctccatcctgcatcctcagggagtgagagctgtgatagggtgggagggaggcaaggggagtgaacaggaccccagtctgctccctgccagccgatgaggcctcaaggacatggacctcatgccttttcgtttcttttttctttgtttttttgttttttgttttttggttttttttgagatggggtcttgctctgtcatccaggctggagtgcaatggcacgatctcagctcactgcaacctctgcctcctgggttcaagcagttctcctgtctcagcctcccgggtagctggaattacaggtgtccaccaccacagctggctaattgtttgtatttttagtacggacagggtttcgccatgttggccaggctggtctcaaactcctgatctcaggtgatctgcccacctcagccccccaaagtgctgggattatgggcatgagtcattgtgcccggcctctcctcttttctatctctctctcgctctcttttatttttattttttttactttcttccttctttctttcttttcttttttttttttttttttttcctgagatgaagtctcactctgtcgcccaggctggagtgcagtggtgtgatcttggttcactgcaacctctgcctcccggattcaagcaatagtcctgcctcagcctcccacacagctgagattataggtgcccgccaccatgcccggctaatttttttttttttttagatggagtctccttctgtcgcccaggcaagagtgcaatggtgtgatcttggctcatggccacctctgcatcccgggttcaagcgattctcctgcctcagcctcccaagtagctgggattacaggcatatgccaccacgcctggctactttttgtatttttttagttgagacggggtttcaccatattggccaggctagtctcaaactcctgaccttgtgatccgcctgccttggccttccaaagtcctgggattacaggcatgactcattgcgccctggctaatttttgcatttttaagtagagacggggtgtcaccatgttggccaggctggtctcaaattcctgaccttcagtgatctgcccatctcagcctcccaaagtgctgggattacaggagtgagccaccacgcccagccccttcctttctttctttttcctttttttaaggcagggtctcactcagttacctaggctgaagttcagtggtgcaatcaaggctcactgcagcctcaatctcccaggctcagcctcccaagtagctggaactacaggcatgtgccagtgggcctggctaatttttgtattttttgtagtgatggggttttgccatgttgctcaaactggtctcaaattgctggcctcaagtggtcctcccacctcggactctcaaagtgctgggattacagacgtgagccactacacctggcctcatgttgtttcttgttcatcttcctgttctcagtgcccagatcagggtttggcacatggtagacccttaaaacactgaacaaatggatgaactaataaatgaatcccttagccctcagaagtagtgctgtaggcattcaacacatttattgaattaaaaagtgattaaatgtgtgttcctagcttgcaacatagtaagcattcagctggaagccaggtgtccttaacttggggtcctaggatcctagtgggaccatagaatggctccatggaggctgcaaatctttgaaattttctgcaaaatattgggcatgtgtacacttttgtggactaagagctcatcacttaggttaataaccctaaaacagatgtacaatacttttgctgagtgaagtcatgaatgtatcttgaaatctgaacccataatatgtgaaagtatgtattcactggagttcacagccaggccctttaattatatacatatataaaattttttttttttcagaaagggtcttgctctgtcacccaggctggagtgcagtggcacaattacagctcactacagcctcaatttcccaggcttaagtgatattcctgactcagcctccctagtagctgggtctacaggctcatgcaatcacaccagctagtttttttaagaggtggggtctcactatgttgcccaggccggtctcctgggctctagcaatcctccttccttggcctcccaaagtgctgggattacaggcatgatctaccatgtcctgcaccttctatttgcagggcttgtgctatggcaccctgcagggtgtgcagccagagagaggggaatcacatgtgtctgtcttccagtaacttcatgactccaataactaacacagcctagaaagactggaattaccctgagagcagaaagggtcagggcccaggagctcagaggagggagactagaggcgcttccccaaaaaaggaatgtttaaaatgggtttaggctcccgggaggcggagcttgcagtgagccgagattgtgccactgcactccaacctgagtgacagagcgagacactgtctcaaaaaataaaaataaaaataaaaataaaaaatgggtttaggctcagcacagtggctcatgtctgttgggagcccaagacaggaggattgcttgagcccaggaggtcgaggctgcagtaaactgtaatcatgccactccactccagcctaggctattaataaagcaaaacactgtctcaaaaaaaaaaaatttttttttaaaagaaaagaaagcggccgggcatgatggctcactgctgtaatcccagcactttgggaggccaaggcaggtggatcacaaggccaagagttcaagacatcctggccaacatggtgaaaccccgtctctactaaaaacagaaaaattagccgggcatggtggtgtgcacctgtaatctcagctactcagaaggctggggcaggagaatcacttgaacccgggaggcagaagttgcagtgaagcaagatcaggccattgcattccagcctgggccaacagagcgagactccacctcaaaagaaaagaaaattggcttagagcagtagtccccaacctttttggacaccagtgaccagggaccggtttcgtggaagacaatttttccatggacagggtcgggggcaggggcggcgggtggagaggatggtttggagatgaaactgttccacttcagatcattaggcattagattctcataaggagcacacaacctagatccctcacatgcatggttaccaatagggctcgcgctcctgtgagaatctaatgctgctgctgatctgacaggaggcggagctcaggtggtgatgctcccttacccactgctcacctcctgctgtgcatcctggttcctaacaggccatggactgataccagtccatggcctgggggttgggaacccctggctcaaaggacaggagctaggagcaaagacagaaacccaggcagtgggaagaaatgctgaacgtgttctgggccatgtaatgtgtacagtttggcctgaacacaaggaatgtactgggcggcggcagcagcagcagcagataagattagacagtcagaggagctgggtcttgctgtgtgaccttgagccagtcatggtcccttcttgtgcttcagcttttccatctcagtactgggttggaaagccctgttctgcctatttctccattgttgttgttttgagatggagtctcactctgtcacccaggttggagtgcagtggtgtgatcttggctcactgcaacctccacctcccgggttcaagcgattatcctgcctcagcctcctgagtagctgggattaatagatgtgcaccaccatacctggctaatgtttttatttttagtagagatggggtttcaccatgttggccaggctggtcttgaactcctgacctcagctgatcagcccttctaggcctcccaaagtgctgggattacagaagtgagccactgcacctggccagttgttatgtattcaaatgagtttgagggtctaaaccacatcagacaagagggacaggctgttctgttttttaaaaaggcccagattagacctgaaaccctcagatgctggaggaaggcttcacctccccacagtcttttttttttttttaagacagtgtcagccaggcacagtggctcatgcctgtaatcccagcactttgggaggctgaggaaggcgggtcaagaggtcaggagatcgagaccatcctggctaacatggtgaaaccccatctctactgaaaatacaaaaaattagctgggcttggtggtgggcacctgtagtcctagctactcgggaggctgaggcaggagaatggtgtgaacctgggaggcggagcttgcagtgagccaacatcgtgccactgcactccagcctgggtgacagagcaagactctgtctcaaaaaaaaaaaaaaaagactgtcttactctgttgcccaggctggagtacagtggtgcgatctcagctcactgcaacttccgcttcctaggttcaaccaattccctaactcaccctccccagtagttgggatgacaggtgtgcaccaccacgcctggctaatttttgtatttttagtacagagacggggtttcaccatgttggtcaggctggtctatgaactcctgatcttgtgagcccgcctcagcctcccaaagtgctaggattacaggcgtgagccactgtgcccggctcacctctattaaaaggacccaaaggagttaacggacagaaaacgtggcagaggcagagatggggtggtatggaccagaatttgtagtttgcagtgatttcgccttcctctcccttcttccgtgtgggccctgtggcacctaatgaagcaaggtattgagatcatccctctggagcctggcatgggcatctcccctctgggctagaacatagcttaacagattgtccgtgtgcctcaacccctcaaaaactgccacttccagttcctaacattcttgttttgttttgagacgaagtcttgctctgtcacccaggctggagtgcagtggtgcgatcccagctcactatgacctccgcctcccaggttcaagcgattcttctgcctcagcctcccaagtagttggaactacaggcacacgccaccacacccagctaatttttgtatttttagtagacatggagtttcaccatattggccaggttggtcttgaactcttgacctcaagtgatccactgcctgggtctcacacagtgctgggagtacaggcgtgagccgtcatgcccggccccagctcctcacattctaaggaagttgtgagatggcagttaagaggactgcactcgagggcaggatttgggaattctaatgtgatgcagtgttattcctctacctggacctgtttgcctagctgtgcaacttgtgcatgacatactgcattgtctttcaaaatgtggttgttgtttttcttttttcttttttttttttttgagacagagtctcactctgtggctcaggctggagtgcagtggcacaatcttggctcaccgcaacctctgccttctgggatcaagtgattctcccgcctcagcctcccaagtagctgggactacaggcacgggccaccacgcccggctaatttttgtatttttagtagagatggggtttcaccatgttggccaggctggtctcaaactcctcacatcaggtgattcgcccacctcaacctctcaaagtgctgggattgcaggcgtgagccaccaagcctggccccaaaatgtggtctttaaccaggatcacaaatgtggttgttaaaaatgcacactccagccgggcacagtggctcatacctgtaatcccagcactttgggaggccgaggtgggcgaatcacctgaggtcccgagttcgagaccaccctagccaacatagtgcaatcccgtctctactaaaaatacaaaaaaaaaaaaagttagccaggtgtggtggcacatgcctgtaatcccagctattttggaggctgaggcgggataattgcttgaacccaggaggcagaggttgcagtgagccgagatcgtaccattgtattccagcctggccacagagcaagactctgcctaaaaaataaacaaaaacaaaacaaaagcacattcctgggccaactcagaaattctgcagtatctgcagtagaatcacaaggtgtgcctgggaagctgaatttctataagctgcactgatattctgttacatagcaagagtttggggacctctagtcttctggctgtgaccatctgattcctcattctttcctccatggctcaggtgtgcagcctgagtgtgggtatgacgattggtgggtgctgaattctcaacccacagacccctgggaaaaatgggtctggaggagggacccacagatcctgaatgagctctctgacctgatgtctaggatgagaggagggggctgaagggcttgcagagcaaaggggactaagtatttagaagtgccctgagtgatgccctgctccttcttaacattcattatttgcaaatatttgagcacctactacatgctaggcttatctaggtgctggaggatacagtagtgaatgaaaatctgtgccctgattaagtttatgttctagtgggcatggcaggcaataaggaaataaataaatgggccaggcatggtggctcacatctgtaatcccagcactttgggaggcagaagtgggtggatcactcaagctcaggagttgaagaccagcctgggcaacatagcgagaccccatctctacaaaaaatacaaaaattagctgggtgtggtggcgcaagcctgtagtcccagctactcgggaggctgaggcgggaggattgcttgaggccgggagatggaggttgcagtgagctgagatcatgccactgcactccagcctgggcaacagagcgagactccatctcaaagaaagagagaaatgaaatatatagcatgttagtgacacgtgctgaggagaaaaacaaaacagggaagggggatagaaactggtatttgctaagtgcaattttagatggggttttctaggaagtgctgtgacgtcatcacttgctttaaaagaggccaggcgcagtagctgactcctgtaatcccagcactttgggagccccaggcaggcggataacctgaggtcaggagttcacgaccagcctggccaacatggtaaaaccccgtctctacaaaaatacaaaaattagccaggcatgatggcgggtgtctgtaatcccaactactcgggaggctgaggcaggagaatcgcttgaacccgggaggcggaggttgcactgagccgagattgcactactgccctccagcctgggcgacacagcaggactctgtctcaaaaaataaaaataaaataaaaataaaaatgctgggcgcagtggctcatgcctgtaatcccagcactttaggaggccggggcgggtggatcacctgagatcgggagttcaagaccagcctgactaacatggagaaaccccgtctctactaaaaatacaaaattagccaggcatggtggtgcatgtctgtaatcccagccactcaggaggctgaggcgggagaatcgcttgaacccgggaggcggaggttgcagtggaccaagatcgcgccattgcactccagcctgggcaacagaatgagactccatctcaaaaaaaaaaaaaaaagaaagaaagaaagaaagaaagaaagaaagaaagaaagaaagaaagaaagaaagaaagaaagaaaaaaactgttatagactgagtgccattttagatggggttttctgggaagtgctgtgacatcatcgcttgctgtaaaagaggccgggcgcggtggctgacgcctgtactcccagcgctttgggaggccgaggcgggaggatcgcttgagcctaggagttcgaagttacaatgagctatgatcaggccactgcactccagcctgggcaatgagaaagaccctgtctcttaaacaacaacaaagtcagaaggagaggctgccatggctacggctccaggtgacgtcacggccagctccgtgacgcgcggccagggcagcccgcggagaccgaggctcctctgtgacgtcagcagccggccgggacacagcgggagggcaggtgcggccgcggggcctgccgacttcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaactttttcagcgagaacagctcaatgagcatcacctcggaggacagcaaagggctccggtcagcggagcccgggcctggggagcccgagggcagaagagcccggggcccgagctgcggtgagcccgccttgagcgcgggagtgcccggaggaaccacatgggcaggaagctctcagcagaagccagcgcctcggagccacaactggcagacagcctgtggcgcggcaaccgtgaggggcggggcctcgggtgcgggcggggtcgaccccgggtgagccagtggagggggcggggcctaaagggcggtgctgggcggggacggggctaagatgatatctgggcacctcctacaaggtgggtcctgtagggtaaagggatggtgctaaatgagatcccttaaggggcggagcctcggtgtcctggacggttatgggaaggggcggggaaaatcttgtggttgggtgccactgagggggcgcggcctcaatgttagcgtgagtggctcccaggacaattgggttccaccaagatctaaggctgggggcgggtcatccgtttgggggagggaccaactcttttttttttttttttgcaacggagtttcgctcctgttgcccatgccatgcaatggcatgatctcggctcaccgcaacctccgcctcccgggttcaaacgattctcccgcctcagcctcccgagtagctgggattacaggcgtgcgccaccatgcccggccaatttttgtgtttttagtagagacggggtttctccgtgttaatcaggctggcctcgaactcccgacctcaggtgatccgcccgcctcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagtacgggccaggccagctgcgatcccctctgaccctcgggttcccctctccgaactccagttctctctgagcccccggcccccgtttgagtatcgagcccctctccgagcctcaactcattcctagcccccatccaattatcctagccgaccctctcttcctgagccccaggcccacccccggcccctcccaagccccttctgaacccggacaccacgcaggctgagccccgcctctccctgccgtgggcccctctctgaccctctgtcctggcctcaggcctgctcttccaggggctgagcgtgttgttatccctggcaggagacgtgctggtcagcatgtacaggtcagaggaagggacgctggcgccccaggaacagctctttggagggggtggggagcagggccggaaccttgctggcgcttgagccgattcagatctgattgagtcatgttggcaagagctgggtctaggaccctggggtggggactggagggttgagcaggtcggggcctcagcctccctccggttccccagggaggtctgttccatccgcttcctgttcacggctgtgtcgctgctgagcctctttctgtcaggtgaggggcagtgaattccctggagcccctgccctgggtgctttggaggcaaacccagcacattttctcctacatcctcggtcctgcagctcctggcattcccctgcagaaccccctaattccccctcagactcccacggtcctccccaggcttaaccccctcaagcctctttccactgtccccctatgccggggaaacccattctcttccttttccttctgagacccctccctctctttctccagcattctggctggggcttctgtacctggtctctcctttggagaatgtgagttggggagactgtcttggggtagggggttggcaggttgtgaacccggagattgtgggggtcccctggactgtcggtctgctggggtgggggtagtgccagaggctacaatccttaagaaagggctggatataaacagacttatgagggattgtgcttgagggtctcttgggggctctgatactgggaggtcaaggaggagtcgaggaaaggggacacagtcttcaaaaaggaagccctggccgtttccaggctgaggtaggagcaaggacgacgggagctgagcggctctgtgttttgtcccttcatccaacaggaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgaggtgagccccggcccaccttggaaacccctgatggatccctgctcccagggtcctgagacttaagctccgcccagagccctgcgggatttctcccggtgcccacgaagtccatcccaaagcaaccagctcccagaggtcccgtccacctgtaaaagcagcccgcaagcctcgcccctccaggcctcgccctccctccttgcagagagtggccaagctcgtgttccagaggctgaatgaggattttgtgcggaagcccgactatgctttgagctctgtgggtaagacccggagacactggaagacagagacgcagacaggaaagaggccaagacactgacacagacagacccatgcacctgaccggccgaagacagagcctcggacagcccccacccgcccccagcccccgcgcccccgcgccccgactcccggcaaggcctgggagcctctgagggttacttctcactgttccaggagcctccatcgacctgcagaagacatcccacgattacgcagacaggaacactgcctacttctggaatcgcttcagcttctggaactacgcacggccgcccacggttatcctggaggtgagtctggaaacatcccgggatgggaccccgggcgggacgctgggaaaagcaccaaaaccccgccctacaggcggagcttggctgagccgagggcgtggaggatggcgtttaactcaaggagagacctggcattgctggggactggggcgggctggaggtggagctctgggcgggtcgatggatggggtcgagctgaggcccgggctggggagcggcagcagtcgctctgtccgacggttccgatggtccctccgcccgcctgcagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttgtgagtgcggacgaggtcaggaggtgggggattttgcctagagagcccaagcagtcttgagaactggtgccgttatctgagtcttcgcttgctcatctataaaatgaagatactactatttgcctctcagagctgctgtaggttatagtcataaccatatccagatattagttattgcttgcaaagcacttactccgtgccaagcagtttacaggcattcttattttgctgttgtttttgagacagtctcgctcttgtcacccaggctgctggagtgcagtggtgccatctcagctcacctgcaacctcagcctctaggattcaagcgattcttgtgcctcatcctcccgagtagctggaattacaggcgtgcgccaccatgctcggctaatttttgtatttttagtagagatggggtttcaccatgttggccaggatggtctcaaactcctgacctcaagtgatccgccttcctcggccttctgaaatgctaggattacaggcatgagccaccgtgcctgctttgcacccacataacaacctatgatgtactgttatctccccctttaaagatgaagaaagtaatgctcagagaggggaagttatttttccaaggtaatacaactaacagttggcaggattaaatttaaaacctggtttcttcccgggaggtggagcttgcagtgagccaagatctcaccactgcactccagcctgggtgacagagcaacactccgtctcaaaataaataaataaataaaacctggtttcttagagcccacattctgaattacagtgtacgaccatcaaaaaatacatgagaacatgcatatagctattgaatacacagaagatcctcagcaaagttttcttctccccgccccccccgccccacctgtccccctcatagttcctcctttcattcttcacccaccagggcctccaggtttatgatgaaactgaagtttccttggggaaattcaccttcgatgttgagaaatcggagattcagactttccacctgcaggtgtgtttgtctctagggtgaaggtgccaagggagtggggcagtgagggatgaatgatccaggaggagggcagcccttggcatgatccatttgtctccccagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaattgagttctgctgaaggatactggatcagtgctttcgggggctctgttgggagagctctggctgccgttgcatctaagtatggaggggctgacttcccaatgcaccctcttttcttggagaagtcttgatcaagatcgtaatagcagctcctgtttatggagtgcctaccacgtacaagaaacagtgctgtggacattacacacattacctaacttcattctcacaaccagaaagggaagctgctcaggtcaggaaacttgttcaatgtcacacagctagtgaaaggcagtgacagagcagtacccaggcccaccttcctccagagccagtcctctaactgcagagctgcaggcagcctgaacccacctttgtgctcaattcccagccccagtgggaaagtccccaactcctgctaggtaccggtggaggggtagctacccaccttctgcaggcacacactcaaaagctaaggagacttgataacctctaggaagcttctgagtcacagagctgatgcaggcctggtagcccctacataggttgtcttactgagacctgagttcccaactctgtgtgaggcacagcatagatgatttagtgttcaccagtccctgccctcaaggagcctgacaggggaaagaagagactccaggaaacaggacaatgcatttacagatccaagaattcttcactctaagggtcgaaagtggaattgcagggaaaaaagatggaggagaaggcaacaaaggattaatgagttctacctaggggtaggaaaggaggaccagcatgagcaaagcaacacgcacaacatgcaccatcttggagggcaatgtgcagtatctggtaaaattttaaatataccctttgatctagcacttccacttttaggaacaaattcttcagaaacattcctgttaagtgcacaaagatacatgtacaaagatgttcattatagcattgtttgaaaaaaactgggattcaaatctccatgaataagagacgggtacgctcctacaaaaaaataagatgtaggcattaacaccttcccaatgtgctcatgctttagaagaatatacagactattaatagtgtttatacttttaagaagtgaaattcggcctggtatggtgtctcatgcctgtagtcccagcactttgggaggctgaggagggtggatcatgaggtcaggagatcaagaccatcctggccaacatggatacaaaaattagctgggcgttgtggcatgtgcctgtagtcccagttacttgggagactgaggcaggaaatcacttgaatcgggaggcagaggttgcagtgggccaagatcgtgccactgcactccagtctggcgacagagtgagactccatctcaaataaaataaataaataaataaataatctgggggatttttttataatttgaagatgaaaaagaccccactgagtgctctcaaggcctatttttatttatcaaagcctaagtttagaattatgaactaatgcagcttttctggagggcagtttcacaacaggaaccaaaagccttacaactttttgtactctttactcacagcaattccatttctaagaatgtatccatagaatacatagatgtattcaaaggtaatatttataaggaaatttaacagtgttgtttataaattggaaacttagtaaccaagtagataaactgttataaaaaataagcagccaatagaaatggtaatataagagaatgtctgaagccactgaaagtaatgatatataggccaggcatggtggctcacgcctgtaatcccagcactttgggaggccgaggtgggcggatcacctgaggttgagagtttgagaccagtctggccaacattgtgaaaccccatctctactaaaaaaatacaaaaaaattagccgggcgtggtggcaggcacctgtagtcccagctactcaggaggctgaggcaggagaattgcttgaacccgggaggtggagcttgcagtgagcccagatcgcgccactgcactccagcctgggcgacagagctagactccatctcaaaaaacaaaacaaaacaaaacaaaacaaaaattagctgggcatactggtgcgcgcctgtaatcccagctactagggaggctgaggcaggagaatcgcttgaacctgggaggcagaggttgcagtgagctgagatcgcaccactgcactctagcctgggcaacagagcaagactctatctaaatggtaataataataaatgatatatggataactttttaaaaagcaagttaaactggcataaataatatgtccatattaaaagaattctatatgccaaaggacactataaataaaaagacaacctgggaagaaatattttcaacatgtatgagatgaaggggctaataaccttaacaaaataaaagctataacacatacatgcagactatgaataggctattgagaagaactataatttacaaataaccatataagataccgatccttcatatttaaataaattcgagctgggtgtggtggctcacgcctgtaattccagcactttgggaggccgaggtgagcagatcacgaggtcaggagtttgagaccagcctgaccaatatggtgaaaccccgtctctactaaaaatacaaaaatcagccgggcgtgctggcgcatgcctgcaatcccagctactcaggaggctgaggcaggagaatcacttgaacctgggaggcggaggttgcagtgagctgagatggtgccactgcactccagcctgggcaacagagtgagactccatcaaaaaaataaaaataaaataaaaaataaaataaattcaaactaaaaatgattttttgcttctttttttacctgtcagattaacaaaaggtgtaactttgaccataatttttgttatgaagaataatttgcaatatctattaaaatttaaaatataacctttgatatagcatttccacttttaggaataaatgtttcttcagaacaaatgtttcttcagaaacattccagttaagtgcacagacatatatgtacaaggatgttcattacagcattgaaagaaactaagactcaaatctccataaataagagatgagctaaataaggtacactcctacaaaaaaaaaaaaaaaaatgatggccaggtgcagtggcttatgcctgtaatcccagcactttgggaggccaaggtgggcagatcacctgaggtctcgagttcaagaccagccaacatggtgaaaccccatctctactaaaaatacaaaaattagccaggcatggtggtgcgtgcctgtagtcccagttacttgggaggtgaagcaggagaatcgcttgaacccagaaggcagaagttgcagtgagctgagatcacgccattgcactccagcctgggcaatacagagcgactacgtctcaaaaaaaaaaaaaaaaaaaaaaaggaatgaagcaataggttctgataggtaagacaccaaaatgtattaaataaaaaggtccaagtagtacgtataaatagcccattgataaaaatctatttttcagatctaggaaaaacaggggcccttacctgctccactatttgtacaatgtgtttttgttttttttttttgagagggagtctcgctttgtcacccaggcaggagtgcagtggcgccatctcagctcactgaaagctccgcctcctgggttcccgccattctcctgcctcagcctccccagtagctgggaccacaggcgcccgccaccacgcctggctaattttttacattttttagtagagacggggtttcaccctgttagccaggatggtctcaatctcctgaccttgtgatccgcctgcctcggcctcccaaagtgctgggattacaggtgtgagccactgcacctggcctatttgtacaatatttatatttgaaataacttcatactaacaagcacgtattttaaaattagaaaaaacaaattttaacacatgctaaaacagtatgtgtagacaaaaagttatgtgcccaatatgttttatcaggacatgggagtttgagtgatattttttctgcacttaaaatttttttcttttctgagacagagtctcgctctgtagctcaggctggggtgcagtggtgcaataccagctctctgcatcctccgcttcctgggttcaagcgattctcctgcctcagcctcctgagtagttggaatcataggcacccaccaccacaccaagctaatttctgtatttttagtagagatggggtttcatcatgttggccaggctggtcttgaactcctgacctcaaatgatctgccctcttcagcctcccaaagtgctgggattacaggcatgagccaccacgcccagccagaatttttctacaatgaatacatgtattctctattaagaaaaaattagctgttaaaaaaattcaggattttcacttgtctttaggaccaaaattaccactactccctcccctccaggaagtctaacatagcctttgctccaccttaaaactcatccatccttctccttttgctgctttttatgaagtctgacactttccatctttgtattcccagcccagctctgccctgagggagggaaggcgaaggctgggtgtttagcttactttcaaactttgtatttccttttcttgtgtgtgtaatggggtcttgctatgttgcccagacctgctctggaactcctgagctcaagcagtcctcccacctcagcctcccaagctgaggactacaggtacatgatacccacccctggctgtattttcaaaaacagtgagtcagtgtctctagaatgaatagatatctgcccagaaatactcaactttgagtggggctttacaccagagacatccttcacgtaacaacccctaagtaaacaaactaaggtgtggagaggggatgtaaacattgctcatagcagcctcctacctaaaaacacacaagagagtggtggcaaagcattggtcttcactggtctttattgaatgagggttgtcaggagcaaaggtgggatcaagagcagcaaaagcagaaacaagtataaaagtatcaaaaaatacaaagtgctagcactgaggagagtgagaagggttgggttgtggcccagagggacctctgggacacaggattgaggacttgccacagcctccaagggaacctaggcctggggggcctgtgcaggatccttggctgagggtggaagtggcttgagcggggcccaaccctgggccctgaagtatgagaccagttgtgtgggcacttctgcgagcacggtctgtgccaatgcctcccgaggggcctgccaagaaaagggaaaagtcagtggtggcccagaacagctgcccaaagtctgtatttcatgctcaagaacccaaccatatcccaggcttagaggaaaaggtgagcatcccttgggcctcaaccctactcacatcagggaaaggtgaaagggtaaactcccagatcaaatttgcacctactcacattctggaaccggcggtagggtacaaactgcacaatgtcgcgggcagcagcctgcccagaacgtgtatgcaggggtccaccatcagcgtccagctgctccatggcctcaaagtcagcaccacccacacccacaatgatcactgacatgggcaggttcgaggcacgcaccacagcctcacgtgtggcttccacatccgtcacagcaccatcagtcagcagcaacagcatgaagtattgctggggacaagcccattcatgtcctgaagcagatcctcctcctaaacccctgcaaacaccccagccacacatccccacactcataagaagtcccttgttacaggccgggtgcgatggctcacacctgtaatcccagcactttgggaggctaaggcaggcggatcacttgaggtcaggagtttgtgaccaccccagccaacatggtgaaagcccgtctctactaaaaatataaaaattagctgggcatggtggcacacgcctgtaatccaagctactaggaaggctgaggcaggagaatcacttgaacccaggaggtgcaggttgcagtgagctgagatcgcgtcactgcactccagcctgggtgacagagcaagagtccatctcaaaaaaaaaaaaaaaaaaaaaagtcctttgttccataaccctcaaggaagcccttgattgccaccactgccactgccacccacgactctcaccgaggcagtcccctgatgtgcagcctgggctgcaaacctggccacatggttgatgatgggtgcaaagttggtagggccatagaggcgaacttggggcagggcttggcggtaggcatccacaatgccctggatgcctgcagaggagagcaagaaataccgtaaaatcctggacctctcaggactacaccagtcctgaaatcaccccatcccagcccaggagatctcggaacctgggtgcatttcattcattcacccttgtaaaccagggtacttaactgtctcctacacatgaggaaactaaggttcaaagagaggaggggacttgccctaaatcacagcttgaattagcacccagatgagagggattctcctggacaaatccaggagagtttgagcatcagattataacctatttaataatgatccatttgatacaataaggatccgtactatggattaattactgagggagaagggaaagctcctaataaatgtaaaaggaagaattacacaatcatttgacaatcacagaaatgactgattcaggcaaggatcatcaatggatgttaaaactagagagtatagccaggcacagtggcatgtgcctgtagtcccagctactcacgaggctgaggtgggaggactgcttgagcccaggggttcaaggccagcttaggcaacatagtgagacccccgtcacttaaaaaataaaaaaactaaggccgggcgcagtggctcaggcctgtaatcccagcactttgggaggctgaggcgggcggatcacaaggtcaggagattgagaccatcccagctaacacagtgaaaccccgtctctactaaaaatacaaaaaaaaaactagccgggcgtggtggtgggcgcctgtagtcccagctactcgggaggctgaggcaggagaatggcgtgaacccaggaggtggagcttgcagtgagccaagatcgcgccaccgcattccagcctgggtgacagagcaagactccatctcaaaaaataaaaaataaaaaataaattaaaaaaaaaaaaactagaggggaatgttgatgtgtgtgtgatgagtatttgtatagtctcttcccagaatatacttactaaatagaaaggagaaaatagtacttgtatagtggagaaacctggtagatcttaccttaactaagtgaccaaagtcaacatgactggtaataggacaaatcaacatcatgttcctctgaatatgatgcactgagaatatacagcatcactttggtggtattcctgccaaaaatgtacaacctgaatctaatcctgaggatttatcaggtaaacccaaactgagggacattctagaaaatatctggcctatactgtttatatcatgaaatgtgaatgtcatgaaaggcaagaagtcttccatataaaaagatatgtgctaactgaacgcaatgtgtgatctgagattttcttttgctgtaaaagacattaggacaattggcaacatctgaataaatgctataggctggataatagcatagatgttcatttcctgattttgaggattggtctgtgataatgtaagaaagagtctttgattttaggagatactgaagtactcagaggtaaaaagccaggtggataatgatgggtacaaagctggtagggccatagaagcaaacctgaggcagggctattcactacagcattctccaacacacgtatacatgtgtgtacatacataaacacatatttttaatcttttttcccttgaaatgtgtgaatgtgtgtgtatatgtatacatgtgtacacacacacacacatatacacacacatacacactgtatacatgtatgagaaaagagaaaacaaatgtggtaaaatgttatgttagggtaattgggataaaggtgaagagcccctgtgaactcaggccctgacccctgagttccaagggactgagctcctatgactattcttgcaacttttctctaagtctgaacttatgttgaaatacaaaattaaaattttaaaacccagatcagatcaggtcaggtcagattttccacttcagcttgtgcccccttgggggtactggggagtcaaaaggtttggccctaaacaaaagggcttggtggactctggcaaaatgcaccctgcaaggaggcaaacaaggcttccactgatgctcaagtaagtacctgttagcttctaggcaaagataataacgataatataacagataccatttttcggagaacacttagtaagtaccaggcttactgctttacttgtatcctctccttgagtactcaatttcctatgtttagtcttatgaaaccaaagcacacagagattaagcaacctgccccaagtcatgtggcatcatttttttttttttttgagataggttctcactctatcacccaggctggagtatagtggcatgatcatgatcatggctcaccacaacctcaacctcctgggctcaggtgatcctcccacctcagcctcctgagtagctagaactacaggcgcctgccatcatgctcggctaatttttgtaattttagtagagatggggttttgccatgtttcccaagctagtctcaaattcctgggctcaagcgatccacccaccttggcctcgcaactgagtgctaggattacgggcgtgagccaccactcctggcctggcatgacgatttgattccagaggcctagctctaaaatccaccctctgggtcaggcgctgtggctcaatacctgtaatcccagcactttgggaggccaaggcaggtcaatcacctgaggtcaggaattcgagaccaccctggccaacatggcaaaaccccgtctctactaaacatacaaaaattagccaggcacggtggcaagcgactgtagtcccagctacttgggaggctgaggcagaagaattgctcgaacccagtaggcagaggttgcaagtgagctaagattgcgccaccgcactccagcctgggtgacagagcaagactctttctcaaaaaataaattaaactaaaattaaataaaatccaccctctggacaatgaaggcaggtatctgcccccactctcccttttactcatgcaggcttgcccctctttgtgtggacagacctgcctcagggtggatggggaaacttacctgcacagtaggggttactggggttgaaattcaaggcaaattcatgcgagacctggagacaagaatgaaaatgaggttctttccccatgacctctgctaagaatgaaaaaggacactggcgtgtgccaagattcctataggagctatggagtcctgagcacttgctgtctacgtgcctgcaggaatccaaccctgcatctcctcttaaagctgagtgccaagtagcaagtaaatttaccacatcccccaaaatcaggaccctgaaactgaaaacaggagtggcagaaagagagggagctcacctgccagtcagggggaacctgggccccaaatccaaatgcagggaacagcttgtctctgtgggaggacagtgtattgggcaaaaggcagtgaggggactgtaagctcagaggctgaagcatctgcagggagcgggtatagcccagagaagcaggtactcacgagtcatagtcctgaaccacgctgcccacactccacagtgccatcaggtactcattgacccctgttggactcaggtagtgtagggagtcaggtgaggaggggtctccattggagccagtgaagtccacgcccacctgggaggaggtgaggaaggcagctaaaggccaccctgagccccagacctgttctcttgcccttggtaaagtaacttacagtgaagttgatctgacagcctcccatcacatagtccagaaaggagtactctgtttctacctgcaaatgaaaccagggtcatgcctggggtgatagcagttggtgtcatggagctcaggaatcagagccttggttacatgggcttttgtctcacccgacaaatcttgacacggatagttccagagttcttgtagcttttctttttctgctgcttctcagggtggatgcattcaaactcagcctggtgaggacagaaaaattagggtaggaaattctcagagcatcagtcaaggactcgagctgccttctccttcctctctcccacaagcttcagctatctaggcccatttccacacccctggcaagaccagcactcaccgggactgcctgcagctgggccaagctggtgtggaaggtaccgatgagatcatgtgacccgtcactgtcataatcggagcattgcacctgagggaaaggtgtgtgtggacataaacaagccaggtggcagatgagaataagtccctccccaggttctcttctccagcgcagtccacttagggggcaagctcctcacctggatgggtgtgctggggttcccaccacagaaatgctgaacggggactgagaaacgcttccatgtagggttcaggttgttcttgatgacctgaaggtggaggccaaggcctccagtgagctctggcatggccccctgaggagctgccacacttctctacccacctgcagtctctttctgagttccaaaccttgctagtcacaggccccaggagattatctcctaccccagcccacccaatcccaggggtctcatacctcagatctgtacaccaggtgccatttcccatcaccctggcggaagaactccagaaatggatctgattttcccaggaagtcctgccaatgcgagaccccagttacaagactcaggaacaaacaaccattatgccatccctctgtccacacccccatcccccatacaccatccttggccccttaactcttggattaccagggcctacttccagacacaccttcttatctaggtttctggcctctacctccatggttactacacgattgtcctttaattcctgagctgagacctaggtaggggagactacatcacctcatgaattcattgatgttaagtccctcctcaacccttgctgggttccttaccgtgatggtcccccgcccagcaggttttccaggcttcagcatcaaggggagagtcagtacctggctggacacaatctggggaaaagcagggaagggagtttcaggataacaggcagggttaggtcctgcttgccccctacctccaggcaggctaggttgtctcacagacctgcatctgaaggatcctaatccccagccctacatacctgtcctagggaacactcagcaccccctaggaagtcatcatccctcagctctggcgtcttgttgtctatgtcatagattccaaagcgtagcttctggactgtctcaaagcggtactcaagctgtagagtcttggagaactcagggcttgagcagttccgcacccgttcagtccggccaagctgtgggcagaggccagtaagcatcacagtcacagcctccaccccaaaacacaatcctagcctccctccacaaccttaacctccataatccgcctcacctcagcccagctgccccctcccacatcctgtaaaaggacgcagagtgggtcagacttggagccgatgtccttgtcaatgagatggtcacaggaaatggacagctgaaccaaggtcacgcagtgggccatctgagggaaaaggagctgggtcaagcaccagggagccttctctccccttccccgactacaggtcccagcttgggaaggccagcaggcatcacccaggcagggctgagcatacgtccacccccgtgacacccaaggaagagaaggcctcatagcctccaaacccctccacccctaggtgagctcactggcacagaagatggcagatacaaccaaccctggtctgaagatattgaaaaggggtactagcctccatctacaactgtgaccccaaactatcctcaccctaaaatttgtcttaatcccaatagggctgtccaaacccagactctaatcttggtctttgcaaagaccaataaatctttctgacccccttactggccccaggccagaccctaatccaagttctgatcctaacataaccccaaatataactatgatccagataatatcctccacaaattatcttcttccaataatttctcactaaccctggggatctaactcttgtggtggagttatgatccccctactaattctcctcacctctactgctaatgttcaactcctcactatttccactgctgctgcccaatctaagccatcactgtttgtcacctggcttacagcattagcctcttcaactggtctcccttattctatgctgtctccacctccgttcccccatgtccaccccaacaggctattctaaatacagcaatcagggcgatcctattaaaacataagtgaggccggacacagtggctcatgcctgtaatcctggcactttgggaggccaaggtgggcagatcacttgaggtcaggagtttgagaccagcctggccaacatggtgaaaccccgtctctactaaaaaaaaaaatacaaaaattagccaggcatgttggcgtgtgcctataatcctggctactcaggaggctgaggcaggagaattgcttgaacccaggaggtggaggttgcagtgagccgagactgtgccactgtactccagcctgggcaacaagagcaagattccgtctcaaaaaaaaaaaaaaaaaaaaggccggggacggtggctcaagcctgtaatcccagcaccttgggaggccaaggtgggtggatcacgaggtcaggagatcgagaccatcctggctaacatggtgagaccctgtctctactaaaaatacaaaaaattagccaggtgtggtggcgggcgcctgtagtcccagctactcgggaggctgaggcaggagaatggcgtgaatccgggaggcagagcttgcagtgagccgagatggcgccactgcactccagcctgggggaccgaggttgactctgtcacaaaaaaaaaaaaaaaaaagtgaggtcatatcacgcctctgcctgaaccctctagtacttcccatttcctactgagcttagaaaaactccaaacttggccagatatggtggctcacttgaggtcaggagttcgagaccagcctgaccaacatggtgaaaccctgtctctactaaaaataaaaaaaattagctggtatggtggtgggcgcctgtaatcctagcactttgggaggctgaggcaggagaatcgcttgaacctggcgggtggaggttgaagtaagccgagatcgcgccaccgtactccagcctgggcaacaaagctagactccatttccaaaaagaaaagaaaagaaaaaaagtccaaactataccatggcctataaggtcctggaaggtccagatttctttaacctgatctcggagtgtctctcttgctcactccatttcagccactttgtcactcctcaaataagccaagtttgtttgttccttctttcgtgagacagagtctcactgtcacccaggctgaagtgcagtggtgagatctcagctcaccacaacctctgccccttgggttcaagcgatccctcccacctcagcctcccaagtagctgggactacaggtgtgcatcaccacacccagctatttttttttttttttttttgtagagacagggtctcactatgttgcccaggctgctgggcaactcctcggatcaagcaatccacccacctcagcctcccaaagtcctggcatgatagtgtgtgccaccacacccagccagccaagtttgtttctaccccaaacactttgcagtacctggaatgtgttctttctctgcattatatccacatggctcactgctccctttccccacaagtctttactcaaaataatcttccctgttttatatatacatatatatataaaggctctcccttttagcccctctaaaatttcaaccccactgcccctggcattgcataccccttttttgctttttctcaatgtctaacattatatacatgtatatactgtttcccccactagaatataaattctgtgagaaaggaatatttagctgttctgtttattgctctatcccaagcacctagacaatacatatttgcagaatgaaatctgaaagttcatctccagccccagctccctgcccagccagctccaaactaactgatgtctcgcccttgtaatcaggcagcaccaagcttctctgattcaccccttccctctgctgggaacattattttcttgcatggttcaccacgacaacacctgggtaattccgtcctcctgcagccaccataacaatcaccctcagacctcttgttatccctgtgtcccccttggcccatatacctgaagaccactccaccagcagtgcacacgaggtcagatctttcactgagcttcactcagcattccatgtttcccaaagctataccctgagatgcctccagcgtcagccctcccctatactgatcctcagtcaatcgctcctccctcgcagcccacagcacctcatcttggtccctcatagtttccatctggaatgctgttatcaaagttggaatgcttcagagttcaacttgcttcacatactgcccctccacagcaccctggcccctgcatgaacagtcccagtgatagaaaacccagtcttacaatccaatcatcagaaagtctaggtccatacaaatcctacccaaactgacctaactctgtggaattcttacttctacctggtagttcttccccagcctagggctccatgggaaggccttaccctatctccctatgagaactcatctgatacctggaagctgtgaacagtcccagctgaaatctggagaaacagccgcagttcttttggctgttgcccctagaatgtggcctgcagacttctgaccatcctgatcactcccttgggggttccccaaggacagacccagagcagaatacatgctccctcaagggatcaggatcacagcttcccccaagtcacaatctgaactccatgcatgtcacctcacatgctctcccaggcagtgtttacacagtacagagacaaataaaaaagaatgctcatttcactaatgctgggaatagtgaaaaatctaaggcagcttaaaggtctatcaactaaatatgatacatctgaacaacggaatgctgaatagtggctaaaaaacaagccagaactatattatattggtatcctatgaaaaaatcaaaaataggccgggcgcagtggctcactgttgtaatcccagcgttttgggacgccgaggcaggcggatcacttgaggtcagttcaagaccagcgtggccaacgtggtgaaacccagtctctaccaaaaatacaaatatcagctgggtgtggtggtgcacacctgtagtcccagctactcgggagccaggagaatcacttgaacctgggagttggaggttgcagtgagccgagatcatggcactgtacacaagactccatctcaaataataataataataataggaagagtatgaccattttttacttcaattgtaaacttccattttaaacttcaattgtaggtgtatctttataacagatttgaatacaaacataaataaatacacacacagaaaaatagaagatgcatcaaatgttttaggtagctcaaaggagtggaagataagaattttgtgaactccataattctgtattgtttcaatattttatactgttttgtattttttaaaaggccttatatgaaataaaaaacaaaaacaaaacaagcaaaataaataaaaaggcctcatcagctttccccccaaatccacacctcaaatcttcttgactgttcattctaagcccaaagcctccacttccagttcaacaacccctacctaacttcaggccttattagtctcttgcgtcctgcttggtttctgtcctagcactgctccacctggtcatcccagatgccagcttccagtctctattccaagtaaaagccccgtatagctgcctttaggttcggagccaaactccctagcaaagctaccttgctgcacaactccaaaggacatacctacatagaatttggtagttttgcaatctggtaaccctgcatccctagatcaaccttcaaagctcttcccagtttgccatcagctctacctcctgccgctcactcacccacccaccgaactagtcatccaaagttatttctggttcatctaacacacatgcctgactttcctgcctagcaaatgtcctgtcatccatggttctaatatgacattattcctttatgaacccttgcctgttttccccaaggattttcttgtctctgctctggatgactgcgatgtttcctcattagtgtttctgcgaccatacacacacatttctgggtttattagccaaacagaaacctgatcatgtcatttttccactgaaaactctggaatgcctttccaaaacacttaagataaaacccaaagttcttaccatggtcttcaaggccctgcaagaccttacccttgcctaactaatcatctagccacgcaactatcctccagccaggttggcctttctgatccacatatacctaacaccaaccttatttaccacctcagggcttttgcactctgtctccctccttatacactacagaaaataagctatactagagtaggaactctggctagctccaggacccacagcagtatctatctatcctacagtagatactcatcagtaagtatttagtgactgacttaacattgaagccacaccataatttttacttttgtctgtctaccctgtaaactatggggtccttgaactagggctggatattatctctgtatcactagtattagtacttagtatatagctggtactaataaccatttgctgaacaaatggtgaatgtgcttttgctcaagtcacacttcaggccttgaactgatgtgtaacaataaatctcccctatcctgatcttgtatagttcaactttgaaatttaaatgcaggactcctacaactcaatattaaatgatagtcaattaaaatgggcaaaagatttgatcaggcacttcataaaggaaaatatgtgaatcagaaataagcaaagtgatccacagcgttaattatcagggaaatgaaaaataaaaccacaatgagatactgttacatacccaccacaatggctaaaagtataattaaaaagaccaccaccaccaaatgctggcaaggatatggaactctcatatattgttagtgaaagcattaaatgtaccactttggaaaacagtctggcagcttatcaaaaaacctaacaaacacctagcccaagagcgattccactcctacatttttagccaaaagaaatggaaacattatgtccacaaagatttgtataagaatgttcacagcagctttattcacaatagccaaaaacttgaaacagcccaggtattcatcaatatgagaaccaattgtgatgtttatagaaaactattcagcaacaaaaaaatctattagtatctgtaacatgaataaaaatgaagaataaagtaaacagattccatttatgaagtttcagaacaggcaaaacgaatctgtgatgtaaatattcagaacactggttgtcctcccttctcccccaggggaagggaaggtattaactgagcagaggcagagagctcccagtggaaagggaaacgttcttagcattctaagaatatgggtcacaggagtgtgtgcatttgccacttccatctaaaggaacactgagtgtacacatctgattgtaaaattttacaaaaaaaaaaaacaaaacccaacaacccataaacaaatgttgcactaaagttaaggcatgttgaaatgtttacaagtgtaccgatgactgaaacttttttgaaatccaccaaaaaataaaaggagttgttgaagaaatgtgataaaacaagattttaagttgtaggatctgaaatggcggatatatgggtataatttttttcaactttgctacatgttgaaaattttcataataaaatgttggggaaactattattttttttttagacagagtctcactctgttgcccaggctggagtgcaatggcaccatctcggctcatagtaacctccgcctcctgggttccagcgattctcccactacagcctccagagtagctgggattacaggcacctgccatcatgcccggctaattttcatatttttgtagagacagggtttcaccatgttggctaggctggtattgaactcctgacctgaggtgatccgcccgccttggcctcccaaagtgctgggattacaggcatgagccaccgcacccagctagggaaatttttaattggagaactacaggtcctccccctggtaagaggttgttgtgaatgacaaaagcattagcagtgattatttggggtggtaagattacaggccacaactggagctgctgtcttctcactccacgacttctcaaatgtccccaaaagagatgcccttggtctgggccaaacacgtgtagtgggctactattatcatcttcctgtgtaggcctcaatttctggtggactattccttcctaatcattaccattacaccacttttcctggactaaatcctttttcagttttttgaacccagaatcaaaccccagccatactgttgtgggctcatgtgtgcctcagtaggataaggggctgaactctcactgatgtgagcccctaaggtggcctggcttccattctgaggtcagagcttcctgtgcaagcagttttgttcacagatttgtctccttttctttctcattggaatcaactctttataaacaaatcttttccatctgtagttttctatcctttgagcaacatttcctttaaatgatctataaaccacgggattattaatctcttccaaaacatgtttaatctcctttgaaatctacctctaagcctatctctgcttagaaatctgtgattaaaactgttcatgtcactcttctgtcctacatctcttgaacaactacctactttaaaccagactcatgtatttttcatatactgccattataattaacgccatggactttcaacctcctttttaggaccaaaatcttccagaaccatattaaatatcacatttgagtcaataaaaaaaatttgtcatttatttttgtgatatttgtgcactctttcatcaccgagcacatcttggctcgatgtctctaacagtctaactggttttaccatttccactctcagtcccctcctatctgttatgttgaagtcacagacattccctgactctaatccaacaaaaccccaattcttataatcctatcaaaatgtgtaacttgcttattatgtatttctcctcttggactgtaacttcaacaagcagagggaccagattagtcttgcttctgtgccaacgcctggaacacagcaggtgctctactgatatctgttaaatttatgaatgctaggaaaggagtgatactcaaggatcctcagaaatgacccaaatctagctctgacctgctactgagacactgagagaagtaggctttctaggaacacccaacaccaaacaccaatttatcttctctgttaggtccccaccccctgacccttccatttgggactagtcgggtgttgcgaatggaacagctgagtctatagctccaacatttttctgcctctgctttctaccacttaggagttaccctttatagtttgttttcttctgtttactccctctgccaacctcaatgtgccctagcagggcacattctctcagtgtcccttaagaaaggcatactcattcccatttttataacttaaaattcacaaaatgtcagaaataaaaaagaactgagtggccatctaattcaagtccctcaatccaaggcatagagggaagatgtggtttggctaaggccacatatatggttaagtgaaatgaagactagaactcaaatattctgattcctacctaatctcaaaccttggactgttgttagacttttttcctctctttgaaaagcccccctttttatattgttgcaatctgatgcagtgggcaagagtgtgggttctgcagtgaagtgaccaggctccaaatactggccttattccttcctagccacaataatgacatactacaacactaaattgatgtcatatctatataacttgggcaaatacttaatctcactaaacttcaggttcctcaggtgtaaactgggggatagtatctatttctgaagattaatataaataatgtatgcatgatgcttagtacagaggctggaactgctatgaccacgtgttagctattatcgttatccttcaagcctagcttatatatgctccccttttcatgatctttccagcactcaacttctcactctggaccactatattcaattcatgccacacgactgtattctgtcgatgtttctccagcttcttgcctgtcaattaaatgacaaagctcttcagaataaacactgtttcagcatctcctgccacacagcatatacctgagcacataatgggaattcaaatacttgaggcaagtctgcagcagtgtgctggcgcaagcttgtatggcttgcaagagccaactgttacatatcaggaaatcgttgaagcaggtggccttggtaagtttaaaactgtagaaattgggcaactgcaaaaagtcatggcttccttcaccctgccagccagtttaccagcatactactgtcgatagggaatcccattctctgctacaagggagtaacttgcccttcattttctatggccacccttcccttgccttgggaggttctaattttcctattcataaccaagaacagatttctcctgggtccagtgggatctaattcagtgccaaatgagctgaaattcatttgtcagtccttaacacttccctcttccacttccaaagtcctaacccagaaaggcaccagcctgcaattcccaattccttatccaccccaggtaatgaccagaagttgtacagaggctgcaagaaggtggcatagagggctgaaggtctgggtggcagggccactcctttaataaaccaatgtcatgctcacactcctattgcctaccttggcatgctggatcagctcacagatgcaggatcaagtcttgaaagccaatcagaaaatcctccataggcttacaaaggaccacccatggaacattgtttcccgtaagactgaaaagacaaactacaccaaccaccaccactcttctttttcctttttggccccatcaaaggacatggagaaggtagacaagttttcttatccctacttttctaactcgaggattctccaaatttacatcagcagctctaaggatattcctcacaggtcacaaactgaaccaaaaatgaaaatcctttctataaaactacacattccttattcatacatatgactaagggctactgaatggtactcataaactgaaattttcaataaatttggtttagatccatatactactaaggagtcaggctgacacaaagtatttggcaacactacaaagcttaacatgtgcacacaaaaactaaaaggtgggaaaatatgaaaaagaagatggccacaaggttttccactttactgtactgggtgaaggtcaaaaacaaaaaaccaaagccactaatctaaccccaacatccccaaaggcttatccaaaagttgaacaaatctgaccactgtacaactaactcttcaaaaagaacctaacttgacgacaaaactggatatggagaaggaaagaagcaaactgaggaggactacatggtcttcaaaagcaggatagggccatctggctgtgacatctgtcaccccattgatcaccagggttgatttggctgatctggctgactaggtgggtgtccccttcctccctcaccgctccacatgcatctgtcccgaagctgcatgctcgattgaagacgaccatccctgagagaggaggactggtctttggtcaaggatatacgagtgctcccctgctagaacctgcaaacaggctctcaaaagcaggataggactgtagcggagtgggtgtttttctctgcccagagactctgaacacaccaacacaaagtcttcacgtgagtacttcaaaataagttcaggcagggtgcagtggctcacacctgtaatcccagcactttgggaggctggatcacctgaggtcaggagttcgagaccagcctggccaacatggtgaaaccctgtctctactaaaaatacaaaaattagccaggtgtggtggtgcacacctgtaatcccagctacttggcaggctgaggcaggagaattgcttgaacccaggaggcggagctgagatcacgccactgcactgcagcctaagcaacagagtgagactctgttgcgaaaacaaaaaaacaacaaagtaagttcaggtccccctctgcaatcataagcttgaccgtggaggccaagaagccctaccaataggtaagggccctccacactatagttggagttggcaaactgaaaaggctccttccccagcagctcagaatccatgacagaagactgctgccagtggcctcccactttccctaaaagtcagggaggggctggggatagttgagggagggtttctacctgaggagtcatacaagcatccatgattaaaacatctttgttttccccttactattaattatttttctctgcctggattaccccacctgtaaagtagggatgataatgttaactttacagtgttatttgtgaggattacatgaggacagtcatagaaagtatcccctgcccggcacagagtaagtacccagtgtcaactgtccctgtaggtgctcacaaacagggaagtgcacctttgggtccttctgcagtatcattaactccttcttggttaattggaccaaggaggagtggatccaggaggaatgcctctggtctacctgctccaggatataactagcaggacagggacagcccccaaaaggagagatgaagactcttcccctttgaatttctcaagctgcagtgtagaatcactaccacactagggaaaccaggagagcagtacccagatcaaaatttggagctccattcctggtcactttagtttaaggtccaaactcagtacagatttccagaaaccgaatggctaggttcatacaatcacagaagcttaaaactggacacaagcttatctaatttaatcccatactgtaaaagaaacactgaggccagagggaaataatctgtcctaagtcacataactgatggaaccacgaaccgattctgagaatgttatttctatatccaaccattttagcaacagttcacattttgtaattcaccccaatctgaaatctaccctgccactacaacagcagtgagactcacatggtctcccctcatgatctatgctaatgttagccttgcacaaacatggaatataattctccctatttgtctgactgctggggaaggaaggtaggaaatcctggactccacatttacaggagttgatcaaaggaataaattttaagtagcaagcatgcatagtgcaaataaggtagaactcacctctaaaaaatgtgatctgtatcaaaattttcaaaggacatctatagggtagtcaattctgcccccatccctcccggctgaaatctacattcttttaatgtctatcacctgtggggtgtctgagacaacagtactataccgccttcctgatgatctccaggactgaggcatcaccaaatacctgtgcatctacagtgtgcacaaaaggagtgtatatctcctacagcacaaaatgagatgagtaaatgaacaaaagcagaccagagctcttggaaaagaaacctacctattgttcataatgcaagccccttacccttcactggaataaattcatttgggacactggggagagtttaagatgggtcttcagaatttacatgttagggaagccgagaaagcaaaggaatatttcaacaacaggaaactacactatgacaaagactagtttacacttgttcctgtctaaccataacttagcaaatggccaggaaagccactacctggttcccgtggtataggaatgtacctagtataagcacaaccaagcacttagttgtgacttaaaaccctcaactgttgaagaacaggaaccttattttgcttttccaccaaagtataagtgctgggtgcacaccactgcaaaaatctgttagtatgagatacagctatggctaagctgtacattcatgtgaagttgtcttaaaagcttgaaggtgacaggtgcttccaattccaatctgtcaattcaatggtcatagaagtaaagcagctcatctacatcagtaattagtagttgcattaatgtccatcacttcagtcagagttacagcacagggaccctactggtcccacaggccaaaccacagaagggagttatgtataaaggctgggccactctccagcccccactgcaatctaatgtgtggagtatagtggagtgtggcattaacaaacttccaagtgggatcacagaaaaatcaaggcaatcagaggcactggtaccagttggtgtgatttaaaaccttttaagaaactgaggccaggcatagtggctcacacctgtaatcccagcactttgagaggccaaggcgggagcatcacttgagccccggagttcaagaccggcctgagccacatagtgaaactacccctccactccaccatcacccctaccccagcaattacctcatctctacaaaaaaattaaaaaaaaaaaaaaatagctacttaggaggctgaagcaggattgcttgagcccaggacatcgaggttacagtgagctgactgtaccactgcactccagcctgggcagcagagcaagaccatctcaaaaaaaaaaaaaaaaaaaaaaaaaagaaacaaaaaaactatttaaccctcttaaatccttcccactgtgtgacttgtggtgtagcacaatgtggttgttatcatttgatatgaagcacaaactctaagtgacaaggctttttttttttttttttgagacagggtcttgctatgttactcacgctagtctcaattcctgggctcaagcgatcctcccacctcggcctcccaaagtgctgggattacaggtgtgacccaccacacccagcctgacaagtcttatccaccaatcaaaagctatgaatgaactactcccacccattaggaggctgaggctagagacagcagtgaaggggcttcagtctaagagttttaagtcctggttacgagcaggtttactatataagcaagcaaagggaggaaatgaacagcagcagaatggaggtaatgaaccatcaagtagcccatttgaatacagtacagctcattcctaaaatgagttaaatacactcaacacctttgactgttcatactgaattatgttctcttgctgggcattgccccacaacgaaatagtcatctcctatcatgaaatggcaagccattaattaagcaaaatgacttgaaactagtaagttactaagatcaatatccagatgtctggaacaactggggagccaattccaatgctcagctgtgccatttaccacttctctatatgacgtttgctgagtctctatgccctaacctttaacattttaattaaaaaaaaatagggccgggcatggtggctcatgcctgtaatcccagcactttgggaggctgaggtgggtggatcacctgaggtcaggagttcgagaccagcctggccaacatggtgaaaccccatctctactaaaaatacaaaaaaaattagctgggcatggtggcagatgcccataatcccagctactcgggaggctgaggcaggagaatcgcttgaacccgggaggcggaggttgcagtgagctgagatcacgccatcgcactccagcctgggggacaagcgtgagactttgtctcaaaaaaaaaaaaaaaaaaaaaagagcgcttcacaaattgcgtgtcatccttgtagaggggccatgctaatcttctctgtttaattcgtttttaatatgtgctgctgaagcaagcacatcttaaacattttcactggaaggaggtccgtggggctattgacagaattcaagggatttggttgtgatttttcccagcactctttcctgcccttagactttcagagtgctgtccttctgtccctgggtctgaaatgtttatgtcaggtggctttttcctccttctggactccagtgatagagcagtatgtagagtagcaagccaccgtggctactcactgctagttaacgttgatccagaaaaggagtcatactctaggatgcttttgagactctaacacaaagcagccaaagcaccaagaataaacccaagaacagcatggtaaagaattaccatttaccagctgggcacggtggctcacgcctgtaatcccagcactttgggaggccgaggtgggcggatcatgagatcaggaggtggggactatgctggccaacatggcaaaaccccgtctctactaaaaatgaaaaaaaaaaaaaaaaaaattagctgggcttggcggcacgcacctatagtctcagctactgagaggctgaggcaggagaatcgcttgaacccaggaggtggaggttgcagtgagccgagatcgcaccactgcactccagcctgggcaacagatacagactccatctcaaaaaaaaaaaaaaattaccatttacctgagcaggagatgaacttgcttatgttgttgaatagacaggggttttcccagaaaagtcactgtaacatcagagaattgtgctactaccagagtacactctttccagaacatttcacaagtcaaaatgatcagattctatactaaaaagataagactgaaataaagccatttttaataaaaaaggaaagccataagtttgattctaccataccctgtaaaagctctacttttgggagattagtgatgatgcacatagttgataaactatttcttgctgtaaaacactggaaagcaggtaacaatgaattacataactgatctctcctgaacaagaaaaggagacatattatcacacagtccacccctttcagatggtaaaagccattttggatatctgtaggcagctgatttcactcagtgatttgtccattgcttagtcaaatcccgattatttaataatggctcagctactacctggaattatatgtctagccccctctaaaacacactgggtatccaaattctaatacaagctaaactctttcaagataaaaagttttcaacatttaagggctttgtttgccaacacatcatacacataaaattctgaaaaggtggatactatggacttgaatcaagtttcctccctgctgttccaagtatcctcttctcttgacacttcagcattagcaggcaaggataagcaacaatttttacctctccaagattaccaaatctacctctccaaaggcacaaaatattttcaggtttaaaaacaaaacaaaacaaaaaccctgacaagataatattatagctcagtaaagtacttttgtgcagttaaagcattaaaagcatcagcctgttttattttttgacaagtttattgaacagtattcaagacttcatctttataaacaaaaacctctgctgagtgatgccaaggcagtatttgctggcaatgttgtggccatattggcaacaagccattttgttgtgtttggtttctaaagtctggactactatagaactgccagtaaaacaatttaaatgtggcaattttgcaagggtggaaaataatttttaaagtgaccacttccagaaattctttccaaaagatttgactagcagcaattttacattttctttactcatttcccgagtgttcttaaaattgatgagattttacacttggcccatacctgtacacaaccacagactccagtaaaagggagctggaatttaaggctttcacgcatccttgtttttatgcaaggctgactatttccacctaaaaatgtaatgtttgcttacttccatacagtcctagattttcatccagtgggttaagactggccttaactacactgaatattactacctgaaattttaaataaagtttcctaatcgaattttcattgttgatgctttgacaacttggagtacaaagctaggaactacatttcacttaacactgtttcattttttaaaaagccactaataataattgtacatccaaactactgtgtaaacacagaacacacctccaaattatgcttgtgaactaaatgtttcactaaagttcagaaaagtttacaaatttgcttatttatgacatacatttgtagatttctctaatcctttaaatcaaaagaaaaatgaacaccaataaaaaaaaaatcagaagggagaggaaaaaaaattaaatctaatggaaaatattctcttccattaatgtcagagtcaccaaaaacagacaataaaatttacacataaaattgaaaatatcatgatagtgtttacaaatgcacacaactttgagcaaagctttacaaatccttcataccatacaaagcaaatgagaaaataatgtcaattcatttctaccccaaacctagttcttaggagaaaattcgcaggaagagaggtatgagtagtttcacagaatacattttcaagaattttttaaaaactgaaactccaatgcccagaacaagataaacagtatccttagcagttagcactgttaataaatctcagatacacaaaaatcaagttccagagggcaaagcatttaattacagtccacaacgagcactgttgtgattcatataaaacatagttctctccaatttctacacaaaccgctcttttaatttatttaattagatgaacaatgaaatcgttttccttttcagcatttatctaagatgtagaaataacaaagtagttgcaataaagtgtatgaaatatttaataagaatgtacgaacatataaccaaaataaattgtgaaaaaagataaaagactttcatcttcaaacaacccatttttctaaaatgaaaatagctttccaatggagaaaatatctgtggctgaaatacaactctcaagcagtgctgaagttttttgcattgtctttggaatgagaaatgattacttaacattaacttaaattaaacagcatatacaaacgttatattgcttttgaaattgaggaggcagtatctagtgatcggtcaaagcaaatctgtattcatgaattatcaaaagacccacaacatagtcacctcttgagtctaaacaatccttctcttaaacaaaaatcctgtactgtcaatcctctaagattgtagtgataaaaagccttttcaaatcttatcaaatgaaactgttgccactcttaaattacacaaccgctgtatttcagtgttccactgactcacaacaccaaaaaggcactgtatatatatatagtttaataggaaatacttattttaaaagactgacccctttgtaactacgctgatttgtaggaaatgttggggatgtttcaaacgaagacaaaggggccatgtaaaagataaaatttggttttcatgatctctcatctatctctccttctgtattgtttataatgtgacacattttcagagcattgactagggaaagtaaccataactagagccctgtaaggccaagtttttcatcacaaggaaagtaaccataattagagccttttatgacagtgagaaaatttgtttttcatatcatctcacctatctccccttccgtattgtttataatataatgtgacacatcttcagagcactgactagggaaatcataattagagccttgtaaggcaagtgttttcatgacaaggacacttaccaaccagaactcatgtggtcctcctgccttagtgtcctgaataccaaagaaaagagtatgaaagggtcaagaatctcaattttctcctctggcggctgcacttgtactctgtatgaagacttttagtaaacaggctcctgatcgaacaactatgccaaaaagcctccaaataacaggactaacacgtatcaatctacgaaccagcatacggatcttttattctatactactactgctaacaaagataatttcaacttcagttttaaaaacctagatataacactttcttatgaatgggcccctctttgtttaaaggccaaaatttcacataatcgggacaggaggaaattgatactacaattagtccatatgaaaaggacttcaaatcaagtatcttaaacacattattaaaagtggtttctggttttcgataccatccaaacaacatgaacaatttttaaactgactaacctaaatcgtggcggtcaaaccaaaaaggctctggtagataaaggactccatagtttatttttatggcaaaagtcttattccacacagttttaagtgtgacattagaaatcaaagtttgaggttatagcacaaacgaagtgtggacttttatatttagggaaaaaaaccaacaaaacagttctgctcatttacaaatgagtcaattagacaaacaaagcagcaacttctgaagcaggactgtctatacagcaaggacccttaagaagcaataaaggtacatacaatgaatctgtatacagaaattttattcaattttaaaagaaaatgaggactttagacaaagctttaccctataacaaagcaaatctgtccagctttaaaccaaattctgagagtagccaacttctattttcagcagctggcaagagcaccctcaatgagttctactgacatttctattttcttcatcccatatggtataaaacaaaaccaatctagactccttgataagctttatgtggtcatttgagttttacaaatggtttctctaatggtatgccaaaatcatttatgtgttctctccagatagctttactgtaacatacagcaatgtttatcctggtgagtgagtcttctgtaaacagtcaaccaatgctctatgttatggaaaccaagctatatgcaattgaaacaatccacaggttctaacctggaaatactaggaaaacaatctggatgcattaatcacagcaatatgaagatctaccctataaaaaatgatgtgaatggctaccctaatacaagttttacttttcttgaacctataggcctgtcatttaagtcaatgacagcagctgtggcttcatcccgagactcaaaggccaccatggcttcacctgtgggcatacctttttcattgtattttaaacacactgagcctgggattacttgatagccataaaagaaatctaaaatctcatcaatagacacagtaaagggcatgttttgcactttaattactgtcggtcctggttttccagaactagatgcaaagccagggggaccaccaatatggattgggccagggccggggccggggccggggccaggcccaaaagctggtggcccacccaaatgcccaggggcacttccaagaccaggagggccacttccaaaccccgggggaccgcctaagctaccagggccatttccaaaattctgagggccccctccaaatcccgatggcccacttaaattgtttggtccacctccaaaacccggaacatccagtcctagaccaggcaaaccactgtttccaactgaaggcataccaggcctagcatcaccaaaggccccgcctcctaatcctggaggagggattggtggcccaaaggcatttgatccaccaaaattaccaggaaagttaaatggaggcccattattggcttcctttgatcctacagtcaggaaggcatgctcttcacctcctgcactaggtattcctgcactgggcattcccgcaccaggcagtcctgcactggttattgctgaaccaggcagtcctgtgctgggcaggcctgcaccgggaagtcctgcactgggcagtcccacaccgggcagtcccgcattgggcattcctggaactgcaggattacctggcacaggcatctttaatcccttttttccttgggcagggggatttttctcaatctctctcatatcttctagggtaactacatgaacaaaagcttctctcccattaagttttttacggtgtaagcgttcagacttacgtgcatcatcttcatttttaaactgaaccaatgcctgtcctagaccttgcccattgttatcaacaagaacatgtacagcattttcatccactgggattccttctaggaactgaagaacatccatctttgtaatgctgaatggaatatttgttatgtgggcacagactttggcagagttgacatccccctctggatttagtatcatttccctctggtcatagctgaagttctgcagtctttttcgaatcatatctatcttttctagcatacctttcttagtaattggatgaacttgaataaagcgattgcccatgtactgtttatgacgacacagagcagccttatagtcagcctcatttctgaactctacaaagccttcgccagttgctttcccattgggtccataagctatataaatactatcttccacaatatccagctttttaaaaaaatcaatgacatgtttgttttctgcttcaaatggtagccctttcaagtaaacacaaaaaccagcctcatgtggtgatcttgaccttgatcttttctgcccactgggcgattttgacctgggaagtgtctgaggagggggatgagtttgtccagaaggtcccatattttgcttaaaagtgatatggcctccagcagctacccactgtctttctgtggcagggctaacttccacatagcgttgaatcatcagcattctgtttcgtttcaaagcttcaaatgtatcttgaggggagagaaacttaaccaatccattcccattatttcgacctacatgatctttcaacaaatgcactgcatcaacacggagcccatgaaaaaaatctctgacatcattttccattgcagaaaagggcattccatgcacactgacatacagatcatcagggttgatggggagtggcttcacactgctctgagagttcatctggatagggttaacaggattcaacggaccaagaaacataggattcagattattgttcaaattcataggtgctccagagccattcattccagcaggtagaggtgccacaggtggcggattcaagggcggcatgcccgacatgggtggcagtggggtcatgggtggcacagaaggaactgggggaatcgggggcacaggaggcacaggaggcaatgtaggtactggaggaggaactggaattgggggaatggatggcattggtggcagagatggcatcgctggaattggaggaattggtggcggcgggactgtgttcattggagaggctgtgcttggaacagttgagctaaacgttgggctcccaaaggaagcccccatatttggaggagctgttcctacgctggctgtggaaaatgtctgtatgtttttgttgctttcatgaacagaagtggtggcagtaactacactgggtgatggattattaaagttggatactgttgtgggcaagtttaccctgctactcattcctgagctaggtggtggtcctgatctactggcatttgctggtggtatatctaagttggcagtttcaaaacgcctacgactcagttcaatcatattctgcatttccgtcttactactcaacaatagtgttacttttgaccctttaattgtaccacctgtgcgcatcataccaagccttgcatcttcatcagtggcaaaaacgatgaaagcctcacccagttcaccccctacaatatgcacgcccccatcaggaatggtcaatccagagaagaagtggcgaatgtccatggtccccgccacaattgggagaccttgcaaacggatgaccacagccatgctgcgctgaaaccacacacacctgcagatgagaaaaggcaacggccaggtcagactcctgtttatcacaccaagtttttagctacaagaatgaccagctaccatattaggccctcaaatattccctcaagctatcacaggcaatgtctttaatttagatattctaaaaactgaacattacgtgccatttacaatgtaaaacgtagacaatttcaacttccagaaggcattaattttggaaacagttcagtcccaagactcaaaaagttcaagaaaaaacaactgtaggacagtaaaatacatatacatcattcagaccactaatcattcagtaagatttaaaagaaatgtctaagtcaaatcaggaaacaaagtttaacaatctatagggaaaaaacatgcaaagaatatatagaagttagtatttaaaactggcttagcatcttccctatatacttgataatttcatagaattatcaagagtgtgattttatagagctcagtctcaaaatccatccaacagaagcaaaaaactagaatactaatgaattgtaaataatacttaagactaaaagtagattcaagtcttaaatgagaactggttccattattttattcatcctaaaacttttcaatctgccttgtacattacaaaaaactacatatggaattatttattataaacaaggttaagacatactaagaagccaaaagaactactgaataggacagctaaaatctgagttaccttgattcattacccccaaaagtagaacctggttatagtcccattcactgtgactattttaattaaaactcaggtccaatgactcataaccaaatcctctatttaataaaattttttaaagtattattttcccctaggagagggctgacaataaaaatattttttgtttttgttttagaaccagagtgtgaattactcagtggttgttacagtcttggacctacacaactcctacaggatctctgtgatctccttagatcatgcctgttttgacataatcaaaaaagaaatgttcccctcaaatttcagtatttcagttccaaaggcttctaagagcaaattcaagggcagccctttggaaagtgacacaaaccgaattattgggcctgggaaacatactactttgaaattaaggtggtcaataacatagggtgttttccaacccatctgaaaagtcaacttttatttatttatttattttgagacagagtttcactcttgtagcccaggctgcagtgcaacggcacgatctcggttcacggcaacctccacctcccaggttcaagtaattctcctgcctcagcctcccaagtagctgggattacaggcatgcgccaccatgcctggctaagtgtttgtatttaggagagatgggatttcacctgacctcaggtgatccaccctcctcagtcttccaaagtgctgggattacaggcgtgagccactgcgccccacctgaaaagtcaacttttaaatataagcccataaaatcagctcatgaccctcagaaaggttataaattaatgaagagatttggttttatcacttctcaagaatattagaaggggcaagattttctactataagctctaagaattctgtaacttcattgtcaaatattatataaatactaatgcaacaaaatctgtaattatatctcaatattacaactgccgtatacaaacaagaaacaaactgcttggctttgacagttttctcacagacacatacacaaaaataaaaagccaccttcaaatttaatccagaaaaatggactagcaaacagaaaatgctttttgtgaggccattataaagcactagaaatttgggaagtgtggggaagcttttcatttacaaacttcaagagtcaacaagaaaaattaacgctaaaaaacatcacaccaacagtctcttttctcatttactatttagcagcctataaggaggttcatcaagcagtttccaagtcattaaatcaaattcacattccttgctcaatctagaatatgtggctgtatgcaaaatgtgatagcatttcctgttcaacttcaaaaaacggttaatcactttgtataggggaaacatcatgggcaatccaggtactcaaaacaacttgagagagagagagagactagtttgcactgggacaatcaaacagaaacttgatatagtcccaagaacacaaaaattaaacacagggctaaagtgacatacacagttaagtcttcaagccattttctgttaagagcagggatttactgaaagtttgtacaaggtacacatgagaatatgctattgaaaatctgcctcagattaccagctggaaagggctgaatattaaaccaaagtggaatacaagatttattcataaagccatctgatgagaaaaattgtttctagcttccaaaaaatatgaaataatatccgcagccaggtgcggtggctcacacctgtaaccccagcactttgggaggatgaggtgggtggatcacccgaggtcaggagttcaagaccagcctggccaacaaggtgaaaccccgtctctactaaaaacacaaaaaattagctgggcatggtggcaggtgcctgtaatcccagctactagggaggctgaggcagaagaatcacttgaacccgggaggcagagatcacgccactgcactccagcctgggcaacaagagcgaaactctgtctcaaaaagaaataaataaataaaacaaataaaaatttaaaaaaaaatttaaaaaagtatctgcttttctgttactaagtaactgtttgacagctaagtcatttcaacctaacttgggcctatcttagttacttaaacaagagggttagattccacttgctaaggttccatttaaagtctaaaatttgtactctaaaacatgtgacccattatctatacttaaactcttaggaaatataaataaacatatcaataacaagcatctgtatttgtaattagtctaaaatgctactaaggaataaaacttactgcctatcaggaaaatcacaagataaatagatccatataaatgaaattgacccccaaaggaacaactgttcaaagcacccatctaccccacccctatccctcagataaacttgtaaaaaaccacaccggcctgggtggcggctcatgcctgtaatcccagcactttgggaggctaaggcaggtggatcacaaggtcaggagttcaagaccagcctggccaagaggataaaaccccatctctactaaaaatacaaaaaaattagccgggtatggtggcaggcgcctgtaatcccagctattcgggaggctgaggcagagaagtgcttgaacccgggaggcggaggttgcagtgagccgagatggcaccactgcactccagcctgggcaacagagtctagcctgggcaactgagcaagactccgtctcaaaacaaaaaacaagcaaacaaaaacacacacacacacacacacacacacacacacacacaatatagttgctacatatattttcatatttcttaataagctatctcattttattttgtataaaaacgaactctctattcaaaatctcttacctgataaaacaagagatgaatttccttaacaagaagtagaggccaagtcaatcctgtgggcaaccaattaaaaccaacttttagactgcaatagagaataaacggaggcaaaaatcaatgcaggaaacacaaaacaacacgcacaggccacactgtacattacgaaggcgagtctgaaaccaccagagtacttcattagaatgcatatcaaaaaaaaaaaaaaaaagaaagacaccgtaacaaaatcccacacatgctttttagttggtattgctttcaaatttgagtatctcaaaataattatatatttacaagagtgtcattaacttagcccaataacgaatccactgaaaattaaaacagtcataaagctcagcttcacagctaattgctttgatcactttataattaaaccagtccagaaaactccgtaacacaagtctatttccccaggttctcaccaaatttgtgatgaaaaggcacaagttcgcacaataacaattcttggacaacttaagatagcaattcaagggtactcatggaaattactgcaattattctttcaatatattttattttgcacaaaatagcatccaacatcacaaaacaaatgaagtatgagttcttgctataaggactaattccactggagctcaaaatattaacaaaatattaagggaaagtgttttttcctctgacatcacaacagttctcaaaaacttgtaaaatttaaataaataaaataaaataaaatttaaaaacaccctaaaaatgcctgacatattaagagtatatcccaaaataaaaacaggtcactcatctttcactgtcatttcttccaaactggtgaggttattaacaagtcacaagcatatatgaccaaatgtctagacaactatattcaaaggtcattttttgctttttattttttttcaaaggtcatgttttaattcggagagagaagaaatttgccactgttcagtattaagattacctacgactacttttccaaatgatgctcatcttaaattagtatcttccaagaccaaaatacaactaatgaccttaatattcatcgccaaaaagtaaaacatatttcaaaaatctgtgtgattttctaaaggacaaactattcatcgtctagtcaactactcaagttgctaaagaatagtgagatggttttaccacaaaaagctatgcaaatatgtaatcaacacaatcaaaagtctagagcattgtattaatcttttacatgttgtagaaatctagcctcttttttttttctttttttgagacagggtatcgctctgtcgcccaggctagagtgcagtggcgcgatctaggctcattaggctcattgcaacctccgcctccctgggttcaagctattctcatgcctcagcctctggagtagctgggactgactacaggcttgcgccaccacccgcagcttatttttgtatttttagtagagacaggggtttcattatgttacccaggctggtctcttaactcctcacctcaagtgatccacccgcctcagcctcccaaagtgctgagattacaggtgtgagccaccacgcctggcctagcctaactaagtctaaggagtttaaaaattcttcatttgaaagccatatctagtagtttaacaggtcacaaaggaaaatgtgaaacagaaaaaaacctgcttcaagtaaagcaatgagcaagagcatgaagtactgtaatatttatgtacaggtttgactccagcagccacataacagggtaactttctagtttctagaacttgtaataaacatctgatccctactggagattccaattcaaaaggtcaggtatggggccagggcatatgcctgaatataaggtaagaaggttcctctcagcctcttcccttgcaaactcaaaagataccgtatgtctatcttgagaaggacatatctggggtcagccagttaagctcaaagggaactcaccaggtctactctcaaaaatttctaaaaggttaccagaaattacctttaaaaggaagatatttctcattccacaaggcaaggctgaaaggcccagctgaatttgacaaatgcctagttcaagttttatgtgtacaacttaaagcacaaaatcaatccagatagaaatttatgattctcttctatttcagcaaagaggaatacccaccccaccccataccaaggaaaaccatgcagaaagttgatgctacaagtcagaacttcacaacccttggtattatacctcttcaaaagggaaaggtaaatggaaatagaactgaaatacttctgtgttgacacctcactttgtaaaaaccacaagaatttaacataagtgtcactgttttccaggaaactactattcctgtattctaaatgtcagctagcgactgaatgcaggatttcaaaaatccacgccatttacctaaagctttgctgaactttagaaggataagactaaaataataactaaacaataaaacatctaaaatacatattctatctatacatacagcataatgataggaaaggagaaaatgggcctgatttgtcattaaagccactgatatacttcagaagatctaaaacaagaagctggctttagtatgttttccattcatattatcaggaattagtcctaacataaaggcttgcttcaacttgacaaaataccggatgcatgcacaaatcacaagtatctgctacaaaaatttaacatattatggcaagacagactttcgtatttactagccattctaatcacttggaatttcagaaaaaaatgtctgacaacaaatctcttcatcaagaagtcaaggcacaaactaaaacgactattttcactcttcatctggtagtaaacatccaaaagtgaactttaactttgttcagttatcactctttaatcaacaagaaccagggtacagcagagctaggttcttcagatccaaaagaaacaaactctcaaatgttcacctcagagattagcaacagagaaccaatcacaacgggcacaatgctaaaaacagtataatcacattataataaacattatgaaacaaccacagtttcagccacttgattttgttccccattcccaaatggaccatatatcaaagtctgggatcactcttaatgaaaaaattattctgacactgatggagatgtgtactttttataacgcattactcaatttttccattaacctccattccgtactcaaaggcagcaaatcagaagacatttctaaataagatattcctcctgtcaaaaatattaagttatgtttcaatccccccaaatgccaacaaaaatgttgctaccttcattttcacttcagagcaaaattatacttctaacctaaacaaccacattcactctgtttttgagtcttaaaagctggctttaaacttaattaaattttgtgcaaaccaaaaggtatatgggtgtggtagtaaaatctgataaaactgtagtttagataaaattatcttttctgtttagttgaaaacatttaacaatattcctttactccatgaacatttactattaagcacttgtgggccagacaaaagatataaaagtggacatcatcagtctctgcattttagggagggacatctaaaagcatcttttgtgcaaccaactactgacacttggttcttcctacaacatctacagaagaaaacatacattcatacaatgacagaatggctctctgcaaaatggagtaaaaactatcaacactgtcactggattccagcacctggaacacactggcccacaacatcaagtttcacacctaaagactgtactaacaactcccaaactctcaatactcaatcatcaaaacatttgacgtgtcaaagaaggtgaaagaagcccaaagagtactggtattagcatgtaacaatacgttgcaagtaaccacacaattatttctaaagcttcacatttttcatctaacagatttgaacataaagaaaatgaaaattatacattacaatccataagcaaagtaatcacatttaatcgagcatatataaaaatgtattccctgtttcattaaaaatctgtccaataatatatactaagcacatcttcattgttttgtataaacacgccaaacatttcactttcttcataaattaccataacgttatttgaaccacctgtaacagttcttcccaactttttatactctttgaaaatgtctgcacactttccactaaatccagaaatcctccattcttatcaaaactgccaaatttcaaaaacaagtacaaccagtcttgtattgtagttctataatttaaaaaacaagatttccctatgtgtccagacttgagggatttttctcgactgcaaatgctctgagatgcattaacaatatacactagttaacaaggtcccagacaattcttgttgctaagactgcattttgcaaaaattacaccatttcaaaccattcaagcaagaagctctaaaatactgcagtcacaagcctagcctctcccttcaacaaaccttcagttgccatcacacttttttccagtgggttatactgactctattattgaataatataaaacggtccctaccaacttcttcaatttatattaggttatctctgagaatcctggagccaaggagggttttagggcccagaaatctcttaaagtctgcaattctcagcatgacaccacgcagatgagtaaatgtttagcacttaatactgagtaaccctcacaagagcccctcagatttgtcactataaagcacacgttggaggcacacaaaaagcccgtacgtttacaacctagcagctaagcctgctgcactggcgtccaaccccgtcactaacctgtagatcctcaaagtccctcccaccacccaattcacgtggctgcaaactaatgcagccaagcttcagagaaactcaattaactctccatcaaaagcacccaccctccgcagcccactggatctcgtcctcctgaaatgccacaggatcctctcccgagggagccgtaaatgtgctgctcacagcagccccttccctactgggggaccaaaggcctggcatcttactacaattctcagagcctcaggaggcgtactcaccccaccccctcacctcctagcttcagacgccggcttctcaaaactgctacaccctcgagtaaagcccctccccagcaatggacctcggaggcatttcactgcaaacccctccaccttcaggccacgaaggcggccggttgtgacacttcctttctgaactcacaggagtgtaccgactacagcttcctccccacaggtgtgacctgggtccccttttgctggtaggccacaaaggcctcctttccatttcgggttgaaggagtgtcctcactacgattatctccccacctccaggcacagagatgtagttataacctctgcttcactgggggagacaagaaatcctccgtactcgggatgtaggcgtgtttttactgcagtccccgttagctcgcaggccgctgagccagccagctctggcctgccccctctcagaccacgggggagtcctcgctatggcctcgtccccacttcggtacgcaggctcatcctcttgcgtcctccttgcatcctctcagatctcagaggcctaagtggcatcccactccccctgcagccctgcctcgaccctttgtgtggggcgctagttgccgcgggctcgaaggcctccgaaggccccgccccgggccaccaaggggcaccacgagccccgcacagccccacccgttcaggggctgcgggagtcttaccggggaaagctgcgcggcaccagaacccagaccccgaattaccccccgcgcgagtgcctccgccccgcggccgacagccccagcccgaacggcttcccggagcccaacgcagccaccacctccttcgccgcttcacaaaatggccgtcggcccgctcagcggctccgcgttccagaagggggaggaacggcgtggttgacgtcaaggggccgcgcaagcgcgctgacggtctcgggcgatctcccggaagttactgggttttgtgctaagagggggatattcagtccctgcttgcgactgttggcgcacaggaccgaccttgggctagtggccctggcgggtgggctgggtatgagtgtctagcttggcccttcactgcaagactgtgcaaattgcttcacgtcttccagtttccgcggaaggagcgaattgtgcttacctctaagttttttgaggattaaatggaccacaacgtggtggctagttattatatcctgacaaaacagccaaaacctgattcttttttcccatttaagagtttatacaggccgggggccgggcgcggtggctcacgcctgtaatcccagcactttgggaggccgaggcgggcggatcacgaggtcgggagatcgagaccatcctggctaacacggtgaaaccccgtctcttctaaaaaatacaaaaaattagccgggcgtggtggcgggcacctgtagtcccagctactcgggaggctgaggcaggagaatagcgtgaacctgggaggcggagcttgcagtgagccgagattgcgccactgcactccggcctgggcgaaagagcaagactccatctcaaaaaaaaaaaaaaaaaaaaaaaaagtttatacaggccgagcgcggtggctcacgcctataatcccagcactttgggagtccgagaagggcggatcatgaggtcaggagttcgagaccggtctggccaacaaggcaaaacccagcctctactaaaaatacaaaaactagctgggtgtggtggcggtgcttgtggtcccagctacttgggaggctgaggcaggagaatcgcttgaacccgggaggtggaggttgcagtgagcccagatggcgccattgcactccaccctggatgacaaaagcgaaacttcgtctcagaaaaaaaaacaaaaaaagagttttaatctagggcagggcgcagtggctcacgcctgtaatcccagcattttgggaagccgaggcgggcggattacctgaggtcaggggttcaagaccagcatggccaacatggcgaaacctcgtctctactaaaaatacaaacattagctgggcgtgctggctggcgcctgtggtcccagctaccagggtggctgaggcaggagaatcgcctgaatccgggaggtggcggttacagtgagccaagataacgccatagcactccagcctaggcgacagagcaagattccgtctcaaaaaaaaaaaaaaaattaaatccatcgtgacccctccacggcttcactatagtattattttattatagaaaaagctattctctggctgggcgtggtggcttacgcctgtaatcccagcactttgggaagccgaggtgggaggatcacgaggtcaggggatggagaccatcaggagagcgagactacatctcaaaaaaaaaaaaaaagaaagctgttctcaagccgctttgggcctagccccccgaacttcatgcccctgctaattaaaagctggatgtggtggcttaagtctgtagtcctagctactcgggagttagaggcaggaggatcccttgagcccaggagtccgaggctgcagtgagctatgattgcatcactgcactttagctcaggtaacaagagcaagaccctatcacttaaaaaaaagaaaaaaaaggttgaaattatcacaattccaacaacctttcgggatttctatggcagactggactggtgctagcccagtatgccaaaaacagcaagttggaaaaccaggccacactgttaaactaaacctatgctttataggtttttataggtttgctctgtgtaggtaaaacatagtccattaaaaacaaaacctactaaatgcaatgtagcatccagggttggatcctggaacagaaaaaagacaggaaaactggtgaaagctgaataaaatctgaagtttaggccgggcatagtgcctcacacctgtaatcccagcattttgggaggccaagaggcaagaggattgcttcaagaccagcctgagcaacacaggcccagtctctataaaaaaatctttaataattttagaaaatcacgtttcattaatactaatataccaatgttaacctctaagttttgacaaatgtaccatagttttcttttgttgttttttttttttttttttgagacagagtctcactctgtcatctaggctggagtgcagtggcacaatctcagctaactgcaacctccacctccaggttcaagcaattctcctgcctcagcctcccaagtagctgggactacaggtgcgtgacaccacgcccggctaattttttgtatttttagtagagacgggggtttcaccgtgttagccaggatggtttccatctcctgacctcgtgatccacctccctccgcctcccaaagtgctgggattacaggcatgagccaccgcgcctggccttgttttttgagacggagtcttgctctgttgcttaggctggagtgtggtggcaccatcccggctcactgccacctcggctcactgctacttctgcctccagggttcaagctattcttgtgcctcagcctcccaagtggctgggattacaggcacccaccaccatgcccagctaatttttgtatttttagtagagacagggtttcgccatgttggccaggctggtctcaaactcctgacctcacgtgatctgcctacctcagcctcccaaagttctgggattacaggcatgagccacagcacccagcctattgttgtttttgagacagggtctcactctgtcgctcaggcttgaatacagtggtgcgatcaaggctcactgcaaccttgatctcacgggctgaagcgatcctcccacctcagcctcccaaatagcttggactacaggtgggcaccaccacgcctagataatttttgtatttttttgtagagtaaaggttttgccatgttgcccaggctagtcttgaattcctgagctcaagcaatccatccaccttcgcctcccaaagtactgggattacaggtgtgacccaccacacccagccaaattagcatagttttatgtaagactttttaattagaggaaaactggtaatagatctacaactctactatctttgcaacttttcagtaaatctaaaattattctaagtaaaaaagatatttttcaacaagaaaaattctataatttcatctcctccttccactgtccatctacatttaccaaactttagcccagtggctttcaaactttcctgtccccctgctactggcaagtatgaaaagcaattaaacttttttgaccattatccacaataagaaatacatttataacctggtatacaaattcaaatatatcatcaaaatatattcttaaaatatgcataaatgtactctaacatactatctccttttttaagtactggtaactacccacctatgggttcagacccacaaatgaaaagctctagttacaatggccttctcttggtttctaaagtataatactttgtgctttatcacacttcaggcccttagctcttgccattccttctcacctctcatttctagattagcgagctcttcatatttataagcactacctcctcagaaaaactttcctcaaacacccagcatggtaggttttccctgctatgtcctcttaccacttaattctttcatagcacttatcacaatctataacattgtttatttgtttaattattttccatctctccactaaaatttaaaactcagtgagggcagggtcttttttggtcctgttaaccagtgtattcctaatacccagaacaaatctggctcctggcaggcattcaaataattcttaaatgaagagatacaaaagcccactgagtcatttatgcaaatcagatggagtggcggtcttctccacaattcccaagtacagcttccacttttccctcaacctctcataaagtcacagagtaaatagaaggtgagtttatttctccagtcttgaaattaacaattttcaagaaaacaaattattagaataactggtggagtcacagacatatttctagctccattaggtcaaaggaaaggaaagaggacaagggtagaaaggagacaagccctctaagaaactgtccattcagtctgtctgcagtcaatatgaagagatagcctttggagctacagaaaatattacattgaagtggattatgcttgctgttaaagaagctggtccagccgagcagcagcagaagacgaagactcaaatgtccatgtagagcatcatggtccctgaccaaagagacttcttctggttcctcttgctctcctcaccaagagcacagatgtgcccagcagcaatatgacagcaaatgtctctatggcttcgggatgaaaatgtccacacactttaagacccgagaagaaatggggagtgctccacacccaaggaactgaagctagggaaagacagttttcttgtgtttctgtcatagaggtggactgatgctgaagtcaactggtctataccaatctagagcatccactaggtgtaacaaggtgtctggttgtgcacgggttggtgaggcaggaggggccagaccagcacaaagtcagggccctattcttctagtgttgggtccacttgatgctcttgaggtcaatgccatcctgaaccatctcccagagagggctgccaaagagaagaggcattaaatgagtgagggcttagataggaagtcgacaacattggccccaaggctctgagcaatggcttgcctccttctgtccctgtctgtcctctgcctcttgccctggtagaccctaacacaggtggttaaggtatcctgagctctccagctccctgtaagtccttgtcagctctcctgagagctctccccaactgctaacaggaataactaggttcctcaggctcaattgcagtggggccctgagccaatggacaccaaacatggtcatattcttgaagctttcatcccactggtaagaggctatggccatggtttcccttggaggaaccaagacccttgagacttgtataaacatctagtttaagcctctcttcatatgacatgtataagcagctcgtttcagcccaccacatattacccgcttttcagcatttgtttcttggttttgttctagttcccagttaggggtggaacttaaccctacatcatcttggtatgctgtacccttacccagttcttgcccgtttcatctccccagagttggcctgtgcttccaatatccctgggtctaatccaaaagaattccttggatcttagacctgagcatcccatctcacacaagagctgctgctaagaaatctctgctaagctctgatcgatccccaagcagaagcttggatatcttggataatgttcccagaccagatattacttcagtgtgctatgaatatgggattttacagtttagatttcaccaggtaattttatcaaatttcattatattcttgacttgtccctcttctatatactaaacattcccagaatgcctttctattcatgagattttccatggcccttaaagttagccatctccttcctgtccttcctctttagggaagaccacttattattataggctcacaaaataagactctgagagctaataggaccaggctgcattcagtttgtaaagggtcagaaggaatagggtgcagatgccgaagccacatagataggaaacaaaaggctttgctggccacgtggtcagtagaaatgccttgtgagtataccacagaataccagaaagtgaggacaaaggaagggtcctgcagttgagcaagctatagacacttaagcaatacagctagaccctacaaagaaaaatccagaacacagaaaggcctgggagagctcataaagggaagcagagtatatacctgaaattcctctctctaccaactagatcaagagaatcctgaaagtcaaggttaaccaagacagagccaggctctgaaaaaatctagaggcctcaaggttccaggaggaagatgagctctgtggctactaggggaagccctggtgccagctgactggccaaggatctcattacctttataaacacattgattgattgattgagacagagtcttgctctgtcgcccaggctggagagcagtggtgcgatctcagctcactgcaagctctgcctcctgggttcacgccattctcctgcctcagcctcccaagtaactgggactacaggtgcccaccatgccaggctaatttttttgtattcttagtagagacggggtttcattgtgttagccaggatggtcttgatctcctgacctcatgatccgctcacctcggcctcccgaagtgctgggattacaggcgtgagccaccgtgcccagccacagaaaatatatttttaaaattagctaggtgtgggggcacacagctgtagtcctagctacttgggagtctgaagcaggaggataacttgagcccaagagtccaaagttacagtgaactacaactgtgccactgcactccagcctgggtgacagaatgagacactttctctaaagataataataatcataatgaacaatactacctgggccaggtgcggtggcttgtgcctgtaatcccagcactttgggaggccaagacaggaggactgcttgagcccgggagtttgagaccagcctgggcaacatagcaaaactccgtctctacaaaaaatacaaaaactaaccaggcatagtggcacatgcctgtagtaccagctacttgggaggctgaggtgggaggatcacttgagcttgggaggcacaagttgcagtgaggtgtgattgtgccactgcactccagcctgaataacagagcaagaacttgtctccaaaaaaaaaaaaaaaactactacctgcattacctgcattcatctagttctttagtttgttgtttttgtttttgtttttgttttcttgagacggagtctcactctgtcacccaggctggagtgcagtggtgtgatctcggctcactgcaagctccacctcccaggttcacgccattctcctgcctcacctcccgagtagctgggactacaggtgcccgccaccacgcccagctaatttttttgtatttttaggagagacggggtttcaacgtgttagccaggatggtctcgatctcctgaccttgtgatccacccacctcagcctcccagagtgctgggattacaggtgtgagccactgtgcccggcttttttttttgggacggagtttggctcttgttgctcaggctgcaatgcaatggtacaatcttggctcaacgcaacctccccctcccaggttgaagtgattctcctgcctcagtctcccaagtagctgggattatagggatgcgccaccactcccggctaatttttttgtattttagtagagacggggtttctccatgttggtcaggctggtctcgaacttctgacctcaggtgatctgtccgcctcggcttcccaaagtgctaggattacaggcatgggccaccctgcccggcctagttctttagtttttaaaaacactttctcattgtgaagacaagtagccaagaagatctactttcttgctttgtggaatctctaaatcctaagatccaagtacgcttgaactttggttttggcagtgtaaacacatagcctaaggacaagaggggagacagtgctagagtttcttccaaagcgtctctgatacaatatgtatacctcatttctcgaagacgcttcacatgctgaatgcatttctccactgtgtagtccacttcctcctctgtagtgaagcggccaattccaaacctgaaaaaaggcacaggagaatggctccccatcagagctctggcactgggataaattcattccgcaaatactcactaaggatctacgacacaaaagatatggagagaagaacatggtccttcccctttaggcagagtttctcagaacatggtatatggatcggccgggcatggtggctcacgcctgtaattccaacagtttgggaggccaaggtggacagatcacatgaggttgggagttcgagaccagcctggccaacatggtgaaaccccgtctctactaaaaatataaaaattagctgggcctggtggcacatgtctgtaatcccagctactcaggaggctgaggcaggagaattgcttgaacctgcaagtcagaggcttcagtgagctgagatcatgccactgcactccagcctgggcgacagagtaagactctgtctcagaaaaaaaaaaaagaacatgatctacggaccaccaacattaaaatcacctgagatgttttctactcctcctccggacctagtgaatcagaatatctgaatgtgggactcagatatcatatttcacaaacttcccaggtgatactcaatgaagtctgagaaccactgctctagaaactttcacaaggttatgagaagagataaggagaactcgactgagaaaaacttcagggtggaaaaagaaaaaaactgtaacaggagatgaaaaatataagaggatgcctttcataaatgttgcagctcaactcactgacctgatagaagagtgcgctaaatcctcatcagtgccaattgctctaagcacataagagggctccagggatgcagaggtgcaggcactgaggagagagacacgaaccttgttcagttcatcatcaacgtctacttttagtcacaaaccctcagtcttgttcccatcccccagggccctggagtcataccctggagaaaacaagagaccttctaatctggcagaactaaaggacctgatgctcccctgcacatcctaggatgtgtgaacctagctcctctggcccccatggtggatgacttccttaagcaaggacgctggcaaagtgtgacagagcatgataccacatgggtttgacaagaagacgcagcagaggaccatgtgctcacttccccaggacgtaatgcaccatctgcaccagcctgaagggcagccaaacacttagtggcctttggagcatcttcaattctagaggcctgtaacagaactgctagtgtaacccacaacagacacatacatcccctgggacgataaaaggcacaaaattctaccccaggaagtcttcctagggtggtaaacttcagtctgtacccagctacccagccaaccaaaaaaagagaggcacttacaaaatgacctttacccttaatcaagaggtcttgtgcctatcatctccacactgggaagtttaatagcctgtatgactcttctaagtggccctgccgcaggccctgtctatgccgtccagctcacctccctgaggataaggcaacgtccttcagtgccatcagcagactttccccttccacatatgcaaaggagaggttgatacagcctggaggaaagaaatactgtgagagaggtctcagagtctcagcctctaccagaatgaggatagaaagagcaagtccataccgggataatggtgcttagggtccccattcatcaccacatctggaaggctcttcattatattctgtatcagccgctctgacaactttgagattcgcttgtggtcatactaaggagcaggcaaggaaggattaggcagtaaccattaaccagctcagaaagacagtttgagaagcccttctcctataactggaagtgactatgtatcagccccacctatcatcctatgtactcatggggaccactgtatctccagtactgagcatagtgcctggtatgcaaaaggcgcttgataactggacacagggttcatttacttatccagaaataaatgagctgataactactaaaaggccatgggttttgaagcccataatgtctccctcagaacaaggtgccagcagcaccaggacaaggaagagttttcttaagccctctctccctgcagagatctgcctcagtcatgctgagaagcctctaaataggagacccagcacaggggaagaagttgtgggagggaactgctctccccatacctccatctcttgctgtgccacctcacacgcagcccccagccccaccactaagggtgtgggcactgtcccagaccgcataccccgctcctgcccccctccactctgcagggcctccacacgcacacggggccggcgacggatgtagatggcaccaacccctgggaaacaaaatttgttacaaaaaacagaaagagagaaaagtagataaaacaaaatatttctttccaaagggatcaaaatattacttcaacttttctgtaagcatgaaatttttctaaataaaaaacgttaaggaaaagaagaaacagcagtaaaagcatagtatttagtaaaatatttaacatctggaagataaatgccagaaggagtaatgatcaaaatggtttaaagtagctccctatgctatatgaaatgccatcatacattacagtattattcataatagcaaaaatactgggaacaacttagatgtccatcatcagggtaatggtcaaatagattatggcatgtccatacaatgaaataccaagcaggtgtataaaagaatgagggggccgggtgtggtggttcacgcctataatcccaactgtgggaggtcaaggcgggcggatcacctgagatcagaagttagaaaccagcctggtcaacatggtgaaaccctctctctactaaaaatacaaagattagccaagcgtggtagcaggcacatgtaatcccagctactcaggaggctgagacatgagatgaacccaggtggtagaggttgcagtgagctgagatcaagccactgcactccagcctgagtgatggagcaagactctgtctcccaaaaaaaaaaaaaaaaaaaagaagaagcttgttctgaactgacaccataaaatctccaagatacattgttacaaaactggtgaaatccaaaaaaaagtctgtactttagcttgaaaaaacaaagatgtattggccgggcgcagtggctcacgcctgtaataccagcactttgggaggctgaggtgggtggatcacctgagttcgggagtttgagaccagcctgaccaacatggagaaaccccttctccactaaaaatacaaaattagccaggcatggtggcacatgcctgtaatcccagctactagggaggctgaggcagaagaattgcttgaactcgggaagcagaggttgcagtgagctgagatggcaccattgcactccagcctgggcaacaagagcaaaactccgtctaaaaaaaaaaaatgtattatgggctggacacggtggctcacacctgtaatcccagtgctttgggcagccgaggcggacagatcatgaaatcaggagttcgagaccagcctgaccaacatggtgaaaccccgtaattattaaaaatacaaaaattagctgggcgtggtggcacgcacctgtaatcccagctactcaggaggctgaggcaggagaatcgcctgaacttgggagccacaggttgcagtgagccaagattgtgccactgcactccagcctagtgacagagcaagactctgtctaaaaaaaaaaagatgtaccattaggtgaaaaatgaaagattgaaacagtgagtacagtatgctatcatctggataaaaaagaaagctggaggagaagtatatatttgtttgtaaacacataggataattgtagaaaaacccaagaaattgcctcccaataaccagagaaaatcagaaaaaaaaaaaaaaaaaaaaaaaaaaaccaagaaagaaattacctccccagaagggaactgcatagctggaggtcagaggtgagaggcagacttttgtctgtgccttttttttccctttttttttgagacaagagtcttgctctgttgcccagactggagtgcaatggcacggtctcagctcaccgcaacctccaccttcccggttaaagtgattcacctgcctcagcctcctgattagctgggattacaggcacccgccaccacgcatggctaatttttgtatttttagtacagacggggtttcaccatgttggacaggctggtctcaaattcctggcctcatgatctgcccgcctcggcctcccaaagtgctgcaattacaggcgtgtgccactgcacctggctgtctgtgcacttttttgtagcttttgaattttgaatcacatgaatattactttttcaaaataaaatttaaatttaaaaacaatttggtggagcacggtggctcatgactacaatcccagcattctgggaggccaaggaaggagaatcacttgagaccagaagtttgggaccagcctgagaaacacagtgagaccccgtgtctacaaaaaaaaaaattaaaacttagctgggcatggtggcatgcacttatagtcccagctactctggaggctaaggcaggaggatcacttgagcctaggaggtcgaggctgcagtgagctatgatcgtgccactcactccactccaggctgggcaacagactgagaccttgactcaaaaaaacaaaaaacttaaaaatgcgtataacctgtgactaaacaagccgaattacagaaattttgtgccaaaatatgagcatgagcatgcaaagttattcaccaagtaatcagggcttctgaatagaattggcacttgacagttctcccacacagaaaaactgtttatgctgagaatggaggtactataaaaattaaggcagtggtttccaaatcgattatgaaggacaccagattttaaataataagctgggtgcagtgggtcatgcctgtaatcccagcactttgggagactgaggcgggagggttgcttgaggtcaggaattcaagcctgagtaacatagtgaaacctctatctctacaaaaactgttttaaaaattagccaggcattgggccgggcacgggattacgcctgtaattccggcactttgggaggccaagggtgggtggatcacctgaggtcaggagttcgagaccagcctggccaacatagtgaaaccctgtctctactaaaaatacaaaaattaggccgggtgtggtggctcacacctgtattcccagcaccttgggaggccgaggcgggcagatcatgaggtcaggagatcaaaaccatcctggctaacacagtgaaaccccgtctctacaaaaatacaaaaaaaaaaaaattagccgggcgtggtggcaagcgcctgtagtcccagctgcttgggacgctgaggcaggagaatgtcgtgaaccctggaggcggagcttgcagtgagccaagatcacgccactgtactccaggctgggtgacagagcgagactccgtctcaaaaaataaaataaaatacaaaaattagccaggcgtggtggcaggcacctgtaatcccagctacttgggaggctgaggcaggagaatcgcttgaacccgggaggcggaggttgcagtgagccgagatctcaccattgcactccagcctgggggacaagagcgagactttgtctcaaaaaaaaaaaaaaaaaaaattagccaggcatggccgggcacagtgggcctataatcccagctactcaggaggatgagagaggagaatcccttcaacctgggaggcagaggttgcagcgagccgagatcacaccactgcactccagcctgggcgtcagagtaagactttgtctcaaaaaaaaaaattaggcgtgttggtgcacacctgtagtgctagttactggtgaggctggggtaggagggttgcttgagcccaggagattgaagctgtggcaaggtaggatagcaccactgcactccagcctgagcaacagagtgagaccttgtccctataaaacaaatgaataaaataatgtattaaactgtatttattaagaattatttcatttctccatttaaaaaaattcaagaatcttatactatctgagtctaaacagttcccaaattcaaacagcaagtgctcaaataccatgtctgaacagtgaagaatgccacattatctaaatctatttagattctggacttggaaagcaggaggttggataatgagggacacctgtacacatgtaagtgttgatcagagcttctgatcaatgagttcattggttttttgtttttaaaatttttgtgagtacacaggaggtatatatattatggagttcatgagattttttttgtttttgagagggagtctcgcctgtcgcccaggcagtggtgtgatctcggctcactgcaacctctggctcctgggttcaaacgattctcctgcctcagtctcctgagtagctgggattaaaggcacatgccaccacacccggctaatttttttatttttagtagagacgggggttcaccatgttgatcaggctggtcttgaactcctgacctcgtgatccgcccgccttggcttcccaaagtgctgggattacaggtgtaagccaccgtgcccagcccatgagatgttttaatacaggcatataatgtgaaataggcacatgatgaagaatggggtatccagcctgagttcattggtttttatcaaaaagacttatctacaataaaagccaataaaagcaacattttattaaaagacagaacgcttactgggctttttgaaataataactcacaaaaaacactctacaacctctgggaacccttagaagacgccatcttccataattccagaagctattacacctacttccacaaggtatacacccagataacacaccctgcagacataaaaagggtaccagcacagacatcaacccaaaaaaggccctcacttgagaaagaggagttatattttatatttatattttatggttaccttcacaaaacagaggacaacagtctattcccaagggttaagggaaagaggcataactcaagcttgaacacattccaataggaccatagggaacaaacatgtatccttgagagactaacaggataacagactatgaagtcttctaagaataaacacaaagatagctgggcttggtggctcacatctataatcccagcactttgggaggccgagacgggcggatcacgaggtcaggagatcaagaccatcctggctaacatggtgaaaccccgtctctactaaaaatacaaaaaaattagccgggcgtagtggcaggcgcctgtagtcccagctactcggcaggctgaggcagaagaatggcgtgaaccagggaggtggagcttgcagtgaaccgagatggcgccactgcactccagcctgggcgactgagcgagactccgtctcaagaaaaaaaaaaagaacacaaagagatgtcaaatcccatgcaatcttcccctgagctatagcaagacactgggaatgagggactcaaatagttgctctgcacatcatagtggggaaaacaagatagctgggcctatctagataaatttgatttgacaaaacccatttttcctcaaccaaattaagatctacatgcttgctaaggatttgttaaagagagcaagaaagaatggcctgatgtatagtaactgctaaggtctacaaacaagcaagtgtttctggctattgctaaatgacatttgcattctacaagggactctgaatgtacaacttcctctgagagcaacagtagtcccaaatgactgtgacaaacatctatcaaaggtcttgctggaaggtacagagagaaggaactctagaaggggctggtacctttgggaccgtagattttgtgaccactaatgctcatgagatcaattttcatgtcattgacatcaagtgggatttttccaacagcctgggctgcatcagtatggaaatatacctttctggaactgcaaatccgccctgaggaaacagaggggaagacccacagcacaatgttggaaagtcatctgtcagagtcccacagtgcactgtgaattatctccaatagtaaatgacctgtaaatattaaactcctcccctccctccttctaccccttctccttcctcttttccttccctcctcccccttcccccttcctccctctctgtgtctcagtagcttcccttctttagaataaaaaagatgaagggcaaagcaccagatcgaaacactcgtgatattcttatgcatacaattctcaccacctcattaacaccagcctttcaaaatgtcagattactttctagatcccttttgattaaaaaacaaacaaaacaaaataaaaaaaaaaaaacaagattaacagatctttgtgctaatgtgcctaaagaaattacagggcgatctctatgtggggagaatagagatgttctaaaaggaaaaagagtagcaggcttttttgttttgtggttggttttggcagcaactgcaataaaattaaaaaccataaaaggtgctagacctggccgggagcagtggctcacgcctgtaatcccagcactttgggaggccaaggcagacggatcacctgaggttaggagttcaagaccagcctggccaacatggcaaaacctcatctctactaaaaatacaaaaattagccaggcatagtggtacacacctgtagtcccagctactcaagaggctgaggcggtaggatcatttgaacccagagtgaggaggttgcagggagctgagatcacaccactgcactccagcctaggtgacagagtgatactctgtctcaatgaaaaaaaaaatggtaatagacctggattcaaatactgcctatgacacttccaatgtccttgaacaaagtacttaggctttcccttgatttcctaactacactccatagagtattacagctctcagtatactacctcatacagagccccatggtgggcagggatcagggataagccatgatactcacctatttctgcaataggctgcttcactccaatctcattgttcacagtcatgactgacaccaggctagtatctggctggatagcagcctctagttcctagggatatgcaggagtaaggtgactagatagtacaaacaaagtcctcctaaatcagaatataggcaaacttagtcatgaaaaggagtcttatactacatacctatctgaatagttaactaaaaacagtgacaacacaaaatgttggtgaggatgcacagactctgaatggttcatacattgttagtgggaatgtaaatatcacagccactttggaaaacagtttgacagtttctgtttctcatcaaactaaacatgaaattaccatagaacccagtaactgtacacttgggcatttatcccagagaaatgaaaattaaattcacaaaacatcttacacaaatgttcacaataactttattcgtaataccaaaaacctagaaactacccagattccttcaacagacgattttcgtacatccataacatggactactacttatcaatcaaaaggaacaaactactggcacacgcagcagtgaatgaattcccaaagacttatgattagtgaaaaaagccaataaaggccgggcgcaatggctcacgcctgtaatcccagcactttgggaggctgaggttggtgggtgtcctgagatcggaagttcgagaccagcctggcgaacaaggagaaaccctgtctctactaaaaatacaaaaattagctgggcctggtggcacacacctgtagccccagccacttcggaggttgaggcaggagaaatgcttaaatccaggttgcagtaagctgagattgcaccactgcaatccagcctgggtgacagagtgagactctgcctcaaaaaaaaaaaaagaaaggccaggtatggtggctcacgcctgtaatcccagcactttgggaggctgaggcaggcggatcgcaaggtcaggagatcaagaccatcctggctaacacagtgaaaccctgtctctactaaaaatacaaaaaattagctgggtgtggtggcaggcaccggtagtcccagctacttgggagactgaggcaggggaatggcgtgaacctgggaggcggagcttgcagtgagcggagatcacaccactgcactccagcctgggcaacagaacaagattccatctcaaaaaacaaaacaaaacaaaacaaaaaaacaaaaacaaaaataaaaaagccaatcccagaaggttacatactgtatgattccatccacatgacagtatgaaatgacaaaattaaagaaactgccagccgggtgtggtggctcacgaatgtaatcccaggactttgggaggcggaggcgggtggatcagaaggtcagaagttcaagaccagcctggccaagatggtgaaaccccgtctctactaaaaatacaaaaattagccgggcgcagtggcaggcacctgtaatcccagctacttgagaggctgaggcaggagaatcgcttgaacccggggggcagaggttgcagtgagctgagatcaagccactgcactccagcctgggcaacagagtgagactccgtctcaaaaaaatttaaaaaaaggccaggcacggtggctcacacctgtaatccaagcactttgggaggctgaggcgggcgtatcacaaagtcaagagatcgagaccatcctggctaacatggtgaaaccttgtctctactaaaaatacaaaacattagccaggcatggtggcacgcgccctgtagtcccaagctactagggaggctgaggcaggagaatcgcttgaacctgggaggcagaggttgcagtgagccgagattgcaccactgcactccatgcactccagcctgggcaacagagtgagactccatctcaaaaaaaaaaaaaaaaaaaaaagaaagaaagaaattgctgggtatggtggctcacacctgggtatggtggctcacgcctgtaatcccagcacttcggcagatcacctgaggtcaggagttcgagaccagcctggccaacatggtgaaagcactgctctactaaaaatacaaaaatacctgggcatggcggcaggtgcctgtaatcccagctactcgggaggctgaggtaggagaattgcttgacctcgggaggcagaggttgcagtgagccaacactgtgccattgcactccagctggggcgaccagagcaaaactctgtctcaaaaataaaataggctgtgtgtggtgactcacgcctgtaatcccagcactttgggaggccgaggcgggcggatcacaaggtcaggagagcgagaccatactgcctaacacagtgaaaccccatctctaaaaatacaaaaaattagccaggcgtggtggcgggcgcctatagttccagctacttggggaaggggctgaggcaggagaatggcgtgaacctgggaggcggaggttgcagtgagcagagatcgcgccactgcactccagcctgggagacagagcaagactccatctcaaataaataaaataaaataaaataaaataaaataaaataaaataaaataaaataaaataagggccgggcatggtggctcacgcctggaatcccagcactttggaaggctgaaataggtggatcatttgaggtcaggagtttggaccagcccagccaacatggtgaaaccctgtctctactaaaaatacaaaaatcagtggagcatggtggcagacacctgtaatccaagctacttaggaggctgaggcaggagaatcatttgaacccaggtggcagaggttgcaatgagccaagttcacaccactgcactccagcctgtgtgacagagcaagactcccatctcaataaaaaataaataaaaaataaataaatatagctggggatggtggctcatacctacaatcctagcactttgggaggctgaggtcagaggacagcttgagccaaggagtttgagaccagccttgcaacatagggagaccctgtctcttttttcttcagatggagtcttgctctgtttcccaaggtggagtgcagtggcggggtctcactcactgcaacctccgcctcccaggttcaagtggttctcctacctcagcctcctgagtagccgagattatgggcagacaccaccacacccggctaatttttgtatttttagtagagacggggttttaccatgttggccaggctagtctcgaactcctgacttcaggtgatccacccaccttggcccccaaagtgctgggattataggcatgagccacagcacctggccaagggagaccctgtctctacaaaaagaaaaaagaaaaaaattagctgggcatcatagcctgcgcctatagttccagctactcaggaaggaggctgaggtgggaggatcatttgagcctaggaggtcaaggctgctgtaagccttggtggttccagagcaagttcctctctcattcataaataaatatatagccaggtgtggtggcacacatctctagttctagctgcttaggatgcataggcacaagaatcgcttgaacttagaaggcggagactgcagtgagccgaggtcatgtcactgcactccagcctgggcaacagagcaagaccatgtctcataaaaaaaaattatatattatatatataaaatattttatatatatatatatagcagccgggcgcagtggctcacgcctgtaatcccagcattttgagaggccgagacaggcggatcacctgaggtcaggcacttgagaccagcctgaccaacatggtgaaaccccatctctactaaaaatacaaaattagccaggtgtggtagcgcatgcctataatcccagctactgaggaggctaagtcaggagaattgcttgaacccgggaggcggaggttgcgatgagctgagatcgcgccactgcactccagcctgggcaacaagagcgaaattcagtacccccccgcaaaaaaaaaaaaaaaagaaacacaggggtaaaactccatgaccttggatttcaaaatgaattctttctttattttttttttgagatggagtcttgcttttgtcacccaggctagagtgcaatggcacgatctcggctcactgcaacctccgcctcctgggttcaagcaattctgctgcctcaccctcccaagtagctgggattacaggcgccctcaaccacacccggctaatttttgtattttttagtagagacggggtttcaccatgttggccaggctggtcttgaacttctgacctcagatgaactggtcacctcggcctccaactcccgacctcaggtgatccgcctcccaaagtgctgggattacagctactcagaaggctgaggcaggaaaatcgcttgaacccgggaggcggaggttgtggtgagcagagagcatgccattgcactccagcctgggcaataagagcgaaactccatctcaaaaaaaaaaaaaaaaaaaagtgcaaatgacaaaagaaaaatacatagctttcttttatgaagtgatgaaaatgtcctggaatatgacagtgatgattgttggaaactgtgaatacattaaaagccagtgaattgtataatttcaaaagatgaatgttatggtatgtgaattacatcagaaatttctaagtgcttaaaaaggcaccatgtaaagaactctgaatatcaggcaaaatgaagttataattcatgtcaaaggaaatgggaaatctctcaagatttttgagtaaagtgagaaaaggccaaataagtactttagaaataaagtctgatgaggatgtgcaggacacactggaaggttgttgctaaaggtgtgggcagcaagccacccaggtgccgaggcaagagaccaagggcacgagctgttccagtataataaaatatataaaataagaatagttatactagatatagatcttagatatgattatatatgaatatcattaatcattagtttgtagtgattactctttattctaatattataataatcctcgctctacaatcataacctaggaaaaaccaggccatacagagataggagctgaggggacatagtgagaagtgaccagaagacaagaggcgagccttctgttatgcgtggacagggccaccagagggctccttggtctagcggtaacgccagcatctgggaagacgccctttgccaagcagaccatggtctagcggtagcgtcagtgtcaaggaaaaacacccactacttagcagaccaggaaagggaatccccctttccccgggggagtttagagaagactctactcctccacctcttgtggagggcctgacatcaggcctgcccgcagttatctggaggcctaaccgtctccctgtgatgctgtgcttcagtggtcacactcctagtctgtcttcatgttccatcctgtacacctggctctgccttttcgttagcagtagcaaattagtgaaagtactaaaagtctctgataagcagaaataatggcgtaagctgtctctctctctctcctctctctctctctctctctctctgccttggctgccaggcagggaagggccccctgtccaatggacacgtgacccacgtgaccttacctatcattagagatggctcacactccttaccctgcccctttgtcttgtatccaataaatatcagcgcaggctggcattcggggccactaccagtctccgtgccttggtggtagtggtcccctgggcccagctgtcttttcttttatctctgtcttgtgtctttatttctacgctctctcgtctctgcacatggggagaaaacccaccgaccctgtggggctggaccctacaaaaggactagttcaggcaacagagattaaagtccagaggcagctaagatgcaggatacaatccaaacaaagaaatgagaggaggccgagaaaggtggctcacatctgtaatcccagtgctttgggaggccaaggtaggaggatcacttgagtccaggagttcaccaccagcctggagaatgtactgagatgttgcctctataaaaaatgtttaaaaatttagcaggctggccaggcacagtggctcacgtctataatctcagcactttgggaggccagggtgggcagatcaccataagtaaggagttagagactagcctggccaacatggtgaaaccctgactctactaataatacaaaaaaattagctgggcgtggtggtggcacatgcctgtaatctcggctacttgagaggctgaggcaggagaatcacttgaacccgggaggcagaggttgcaacgagccaagatcgtgccattgcactccagcctgggtgacaagagtgaaactccatctcaagaaaaaaaaaaaatttagccaggccagctgcagtggctcttgcctataatcccagcactttggggggccaagacgggtggatcatttgaggtcaggagtttgagaccagcctggccaagatgataaaaccctttctctactaaaaatacaaaaaaattatctgggtgtggtggtgtatgcctgtagtccttgctgctcggtaggctaaggtgggagaatcgtttgaacccaggaagcagtggtttcagtgagccaagatcgtgccactgcattccagcctgggagacaaggcaatattccatctcaaaaaacaaaacaaaaataaaaatttagccaggtgaggtgagcccaggagtctgaggccgcagtgagctatgagcccagaagtctgaggccacagtgagctatgaccataccactgcactccagcctggacaactcagcaagaccctgtctccaaaaaaagaaagacagagggagagagagagagagggagggaggaaaagagggagggagggaaaagagggagaaaggaaggaagggaggcagggagggaagaagggaaggtgggagtgagggagggaaaagtataattccagagacattataaggaaatggccatagatataaatgttactgattgatgactgaatgtaaataagatgaaaaagagaggaaataatgaatgatgagaacactttggagtttggattgaggggtccatctacaaacagcatgttaggatttgtctaggaatgctgatatccaaaatctggtggataagattcaagaaaatgacactacttctttagcaggatgagaagcatcagtgcagggaaggaggaggccagagctttgccatggtgaatgtgagtccctggcatcctgcacatgtggccagtggctcccatacaaaccagaaaacaccaacaaatgcaagaaacatgtcctccaggccaggtacagtggctcatgcctgtaatcccagcactctgggagtccgagatgggtggatcacctgaggtcaaaaggtcaagaccagcctgaccaacatggtgaaactctgtctctactaaaaatacaaaaattagagccaggcatggcggctcatgcctgtaatcccagcactttgggaggccgaggcaggtggatcacgaggtcaggagttcgagaccagcctggccaatatggtgaaaccccatctctactaaaaatataaaaaattagccaagtgtggccgggcacggtggctcacgcctgtaatcccagcactttgggaggccgaagtgggtggatcacgaggtcaggagatagagaccatcctggctaacatggtgaaaccccgtctctactaaaatacaaaaaaacactagcaaggcgtggtggtgcatgcctgtaatcccagctacttgggaggccgaggcaggggagtcgcttgaacccgggaggcagaggttgcagtgagccaagatcgcgccactgcactccagcctggcaatacagcgagactctgttttaaaaaaaaaaaaaaaaaaaattagccaggtgtggtggcacgtgcctgtagtcccagctactcaggaggctgaggcaggagaatcacttgaacccgggaggtggaggttgcagtggagtgccactgcactcctgcctaggtgacagaatgagactctgcctcaaaaaaaaaaaaaaaaaaaattaactgggcctggtggcatgcgtctgtaatcccagctactcgggagggtgaggcaggagaatcattagaacccaggaggcggaggttgcagtgagccgagatcgcgccactgcattccagcctgagttataagagccaaactctgtctcaaaataaaaaaaagaagtaacaagtcctccagaggttgcagagagctgagatcaagccactgcactctagcctgggcaaaagagtgagactccatctcaaaaaaaagaaaaagaaacaagtcctccagagaaaaggaggacagtacacactcaaggggaacatgatctcgttctctgccaggcttatttctctaaacttcatcctaactgttagatctattccttcaagctccagctagggcccaagagagaaatttacaagctgaagccaggctcctccatttttgctcctcctgccaatagccactcctacctttaggtcaatgatcccactcttctgcactgggaggtaggtgacctgaaagccctcagcttccagtgaacggcaggagtccaagacacatttgtgttctgtctgggtggtgatcaagtgctttttccgtgacctgtagaatcgggccaccccctagaaattggtggtgacagatggaaggagaacatactcagagagacagcaatgacttcaatctcatttgtaaaggaaaagtgggcaagaacagtatgctccaacaccagttctctcataccaactgagtatcctataattcaattctgaggctaactctccagacttagtgaaaaccccatgggttaagggctcaatcgtacaagactgcccctagttcagataccagacataagtcccaggggtctcaagctacccatacttctgcccagtcaaatacaaattcagggcttcccgaagcccggtcaagttcaataattcactagaataaatcacatttgtccaaacccatagaatgtacaacaccagtgaatcctaatataagctatggactttgggtgataatgatgtatcaatatcaggtcatcaattgcaacaaatgtaccacttgatggaggatgctaataatggcagaaggctgtgcatacctgggggcagggcatatataggaaatttctataccttcctttcaattttgctgtgaacctaaaactgctataaaaaataaaatctattaaaataataatagtatacagattaatgtaggtatttaaaaatctggagaaatatacagcaaattagcagtgaaaatgtgtttagagttctactctatattattggaatttatgattcattcatttaaccaatatttagcacctccagtatcccaagtaattttctaggtgccagtgatataacagtaaacaagtcatgagtaggtattactgttaatatcacaagaaacaataaaggtacatttaaaaattcctggaatttcaactattacaagaaactaaaaaaaacatttatctcattgaagaaaaaaaaaaagcggccaggtgcagtgcctcacgactgtaatccgagcactttgggaggccgaggcaggtggatcatctaaggtcaggagtttgagaccagcctggccaacatggggaaaccccatctctactaaaaattaaaaaataagccaggcccggtggcacgcacctgtaatcccaactactcaggaggctgagggaggggaatcacttgaaatcaggaggcagaggttgcagtgagccaagagtgctattgcactccagcctgggcaacagagcgagactgcatctcaaaaaaaaaaaaaaaaaaaaaaaaaaagaacgccaggtgcagtggctcatgcctgtaatccctccactttgggaggctcaggcaggtggatcacgaggtcaggagtttgagaccagcctgacgaacatggtggaaccccatctctactaaaaatacaaaaatggccaggcgcggtggctcacacctgtaattccaacactttgggaggccgagaagggagggtcacctaaggtcgggagttcaagaccagcctgaccaacatggaaaaactccgtctctactaaaaaaaatacaaaaattagccaggcgtggtagtacatgcctgtaatcccagatactctggaggctgaggcaggagaatcgcttgaacccaggagttggaggctgcagtgagccgaggtcacgccattgcacttcagcctgggcaacaagagcaaaactctgtctcaaaaaataaataaataaataaaaataaaaatacaaaaattagcgaggtgtggtggcacgcacctgtaatcccggctactcaggaggatgaggcaggagaatcgcttgaacctgggaggcagaggttgcagtgagccgagatcatgcccctacactctagcctgggcgacagggtgagactccatctcaaaataaataaataaattaattaattaaaaaaaaaaaagggggctggatgtggtggtggctaatgcctataatcccaccactttgggagactaaggcaggaggatcgcttgagctcaggagttcaagaccagcctgagcaacatcatctatactaaaaaaaaaaaaaaaaaaaaaaaaaaaaaaattagcctggcgtggtggtacacatctgtagtcccagctactcaggaggatcacctgagccaaggaggtcaaggctgcagtgagctgagatctggctactgcactccagcctaggtgagatcaagactctgtctcaaaaaacagaaaaaagaaaaaaaaatgggccaggagcagtggttcacacctgtaatcccagcactttgggagactgaggcaggtggatcacctgaggtcagaagtttgagaccagcctagtcaacatggcgaaaccccgtctctactaaaaatacaaaaattagctgggtgtggtagcaggctcctgtaatcccagctactcaggaagatgaggcaggagaatcgcttgaaccctggaggcagaagttgtagtaagccaagattacggcactgcactccagcctgggtgacacagcaagactcccccttgggaaaaaaaaaaagaattaacagtatcaactttgcagaacaggatcagggactggggtccttggggaaggagaggaagatttacacttcattttattttatttttgtttatttattttttgagacggtctcattctgtcacccaggctggagtgcagtggtgtggtctcggcccactgcaacctctgcctcccgagttcaagcaattctcttgtctcagcctcccgagtagctgggactacagccaccacacccagctaattttttgtattttttagtagagatggtgtttcaccattttgcccaggatggtctcgaactcctgagctcagacaacctgcctgcctcggcctcccaatgtgctaagatcacaggcttgacccactgcacccggcctacacttcattttaaatctttccattggttttaaaaaaacacaccatatgtgacagaattatttttcaaaaattaaaaacttggaaagaaaatgtgcatctctccccagagcttataaaagactattacctttaacagcagaataaaaagccaggtgcagtggctcaagccagtaatcccagaactttgggaggcaaaggcaggaggatcacatgagcccaggagttcaagaccagcctgggcaacataatgagagccgcatctctacaaaaattaaaataacaggccgggcgcggtggttcacacctgtaaaaccagcacttcggttggccaaggcaggcggatcacaaggtcaggagatcgagaccatcttggctaacatggtgaaaccccatctctactaaaaatagaaaaattagccaggcgtggtggtgggagcctgtagtcctacctactcaggaggctgaggcaggagaatggcgtgaacccaggaggcagagcttgcagtgagctgagatcacgccactgcactccagcctgggcgacagagccaggctccatctcaaaaaaaaataaataaataaattaaaataacaaaattagacaggcgtgctagtacacgcctgtaagcctagctacttgggaggctaagatgagaggattgcttgagtccaggagttcaaggctccagtgagctgtgattgtgcaactgcaccccagcctaggtgacagaatgagaccatgtcttttttttttttttttttgagacagagtttcgcccttgttgctacagtgcaatggcgcaatctcggcccactgcaactgcaacctctgcctcctgggttcaactgattctcctgcctcagccttccaagtagctaggactacaggggtgtgccaccacacccaggtagtttttgcatttttagtagagacggggttttaccatgttggtcaggctggtctcgaactcctgatctcagatgatctgccggtctcagcctcccaaagtgctgggattacaggtgtaagccactgggcccggctgagaccctgtcttataaaaaataaacacataaataaaataaaagcagaatattaaaccatataggacaaaattataactatgtaaaaatggtctgttcatgaggacaaagaacataaatgagaaacatttataattgatttatactctattttatcctaaaaagtatttacatcagtaagtaaaaatggttgtggggcactttgggaggccgaggagggcggatcacgaggtcaggagatcgagaccattctggctaacacagtgaaaccctgtctctactaaaaatacaaaaaattagccgggtgtggtggagggcgcctgtagtcccagctactcaggaggctgaggcaggagaatggcgtgaacccaggaggcggagcttgcagtgagtcaagatcgtgccactgcactccagcctggatgacagagtgagactcagtctaaaaaaaaaaaaagaaaaaatggttgtgggatggtgatgatagttcaaaatgttacagttgtttataaaaatttcatttaaatgacatttcaccacccacccaccttattttatctcagttacccatgatgtagatttctttaacaatttatagattattttactctaccaatcatggagattaaaagaaacatcatcacaggtactcttagcgatccttgacctgttggtttggaatctgtggagacttccaaagaaaatattttcgaagttttgaaaatgctctccatttcagaaaccatctccacctttggaggaaccttcaccccgactctctggtctctgcagtcccaaggaaggatgccttcctgttaacatgatcaggcagagtgctgatgaccctgaagcccgtcctaggcctcctatattcaggccaaggtcaaagaaaccaacactggcagcacagttcaaagacaaagatgagagcaagtggagccagagttcaaagtacagcaagccacaatttctcagagccttggcatttactcacataatcctggcaaccaggcccagtgaaatctgactatgttctatgaaacaccaacgtgactactaaaagtaccttttccttgcattagcaccaaagatcttctatgtacccaggacaaaatgactgatcccagaatgggtgaccatgtgaatgcctgcagagggcaccacaaagacaagcacttcaaaatggagatatctaaagaaacaggaggaacttgttgcaaatagatctgatcagaaagaaaaaggaaggctgagaggaggacagccctgaaatcacatatataacttgttgttactagataaaaagaatggagaaaggccgggtacggtggctcacacctgtaatcccagcactttgggaggtcgagatgggaggatcatcaggtcaagagattgagatcatcctggccaatatggtgaaaccccatctctactaaaaatataaaaattagttgggcatggtggcgggcacctgtactcccagctactctggaggctgaggcaggagaatcacttgaacctgggaggtggagtttgcagtgagctgagattgcgccactgcactccagcctggcgacagagtgagactatgtatcaaaaaaaaaaagaagaatggagaaaaggttcaatcaccattatccactctctgaagtaactgccagacaaaaaaaaaacaagtggttaatggcctgagggccacctcctttgctatccaactgcctcactcaactcagaccaacagcagcaaagacttaagaaagagtagactgcaaagggttaaaggaagcaacaaatcagaaagactgcaagccttctcttcacaatggggtggggatggatggctgcgaaatacatatacgagtccaaatgatggagggacactatctcctaggtcaggaaagcccacatacaccctctggttcccttctcttaccttaattgctatgttgttggattcagtagcaccactagtaaaaatgatctcacgaggatcagctccaatcagagatgctacttgctgcaagccaagaaacagagatatataacatcagttccccaggcagaaatagagctgcagacacaggtgggacagccctggagcaagaagagctccactgcattccaccaaattgccctggatgaaggtctgcacctacaagaatcagattctagttatatcccagatcccaggctcttttccagcccaatgcaaaataataactttttttttttaatgaactattggccaggtgtggtgggtcactcctgtaaccccagcactttgggaggccgaggtggaaagatcacctgaggtcaggagttcgagaccaacctggccaacatggtgaaactccatttctactaagaatacaaaaatattaggccgggcatggtggctcaagcctgtaatcccagcactttgggaggctgaggcaggtggatcacctgaggtcgggaattcaagaccagcctgaccaacatggagaaaccccgtctctactaaaaatacaaatttacccgggtgtggtggcgcatgcctgtaatcccagctacttgggaggctgaggtaggagaactgcttgaacccgggaggcagaggttgcagtgagccgagatcgtgccactgcactgcagcctgggtaacaagagcaaaactctgtctcaaataatagtaaataaataaataaataaaaatacaaaaatattagctaggcatggtggcgtgtgcctgtaatcccaattacttgggaggctgaggcagcagaatcacttgaacccgggaggcagaggttgcagtgagccaagatcgtgcgccactgcactccagtctgggcaacaaatgtgaaaactccatctcataaaaaaaaaaaaaaagaactattgagctcttactatttatagtacttcttacttacagatgttgtggtaataaacactttatcagcattgtcttatttaatccacccagtaaccctacagagtagaaactaccacaatctctgttttaaatgaggaaaataaggctcaaagaaattagataacttgcccaagtcatttagccaggaaatatgggaaccaatcaaatgcctgcagtcaaactccaaggctgctctttgaatctcttccagaaagaatccaaaaccatttctacctccatgcacacctaccaagaaagaaatgcctcccacaggccactgcccctctttgaccttagaacctcctagactcctgtgtactaacctgacgagcacgttccatggctgcctcactctcccagccataagcatgtgtccgggagtgtgggttcccatagtagttgattaggtaagggagcatggcatcaagcacccgggggtcctgaacacaacagaacagatcattttccttgagcgcatcgtcaattcaggtcccactccacccctcagacctggccaccctgccttaagacactctcaacccctcaggcactgcctagaggaggcctcaaacattcttttgttcccacaaaactacccaccaaatatcaacctaatacactcccactcacaacccatcccaactcggattgttctgcctcccctcaggtagtctacaaacactgccttgttccgacatctgtttctgctggtgtttccattcctgccaggtaatgtgatctataaggggctgggacaggacagggcctaggcaaacacccctggtcacacattggtgaaaacttgcattagtcttttaacccgtttaatacttgtccaagttcacacagttactaagtggccgttctgctcattccagagcccatgcttttaactaatactatagagcctgcgctgaagtgatctgaccaaggtcaattgctagtgagtagtaaagccaatgccagtggcctcgaatttaagcctcccgactcctcgctcagtgctttttccagcacaccttcacggctctcacttctccagggattcagccatttctttgcgtgatcacgcccatcatttacttcctataagcagccttgggaaaagcttcatccttaccagaggagttgtagcttgcacatccatatagagaggtcgcagcactggccccacctccggggcagcggctgtatctgcgggaaccgcagactgaggagcacggtctccaactgataaaaaatggaacggagtagccaagtaagaccgaaggcaactatgaacgcatggcatccaaagggcagaaggaaaaatctggctggaggtgagataagtgtaagggatgctagggtcgaatctcaatggaaagaaaacaacaccagatacctgacacgctgtaaaaggaggtaagggagagggagagagggttcctggagggggtgttgagttgatattcaaatggtatcgtaggaaggaaggctctaaagggcaaagacgtttagaaggaacgtggagccagagtaggtgcagtcccttctgaccgaaggtaacggtctgcacgggagcccggagcagcatctgtaacttggccaggagcggtctgaaggacgcgcctccacggctctgggggcctgtcgcgcagggtgcgaggggtggtgcgccggggtcaaccgttcggggacccgcctaagaaagtttgagggatgtgtcatttgagagaagggtcagagggtctgggcagcagggtggacaggaaggctccggaatattcagttgcgtcgccgcgcggaggggacaggtccgcgcctcccggagagcgggacccgagcgtaccgcgcaggcgcagcccccgagtgggcgccgcgggcttcggccctggagccgctgtcaccgccactgccgcccgcctccaagcggctcggagcagcatggtcccgctggcagagcccaccttccgaagccgctgcagtcctgggccccaggctcccggaagtgctgcccggcgctccggaagcgattcatcgggccgcgagcgccctccccgtcgttttccgtgagagacgtagagctgagcgacccagcccgcgagcgaggtgaggtaggcgccgggcgacgcggggccggaacgcgaagagggtggtggagtcgggctacccactgattttccttcccttacttcccctgagcccttgggcccacttcccagcctaccgcttccgtccccgcccgactcttgggccagcgcctgggcccacactttcctatcccccgcagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggtgaggggcgcgggcggtgatctctgggcaggacaaccagaccttccggccctgccccattcggcctggagcctgaacacagcctccttctttcgacttccctctctgtcccctcgcgagccagactcattccaaaccaccttcaatctgtaaagtcaggttggaagcgtcagtgcttaagaatttgagctttagagtcaaaatgctttctggcccttttcttactggttcggtgactttaggcaagttggagactgggtttccttaagtgtagaatgaagacagtagcatctaacttatagagttgtaaaaattcgatcagcacactttgcacagcatctggcacatattaagtgctcagtaactagttactactgttgcttttatttttttttccaattgcgcataaggaaagaaactcgttcagcggttttactattctggatacaggatacagagataaagcagttaaactttacactctaaaggtcattttcacatttagaggctgttattgccatatccctagattgtaaattatcatttacagagcacttactctatgttaagcactgtgctaaatactgtagttttcaaaatcctgtaaataatgttgagatgcccattttacacttgacactatgtgtaaattgtagagctgactcttgaacccccaccttactccaaaatcattaacaccaagaaactaaaagacagatgtctttattgggtcttaaactgcaggcaacaccagtcaaaaaagctggtttctctatgtattttacactgcatctgctgcctcccacaaactgaaggcagttaatacgacatccaccagaaaaataccctggagacccagatggatctttttccttctcattacccaccccaggtagtaagatataatatccagtaagtggaaaatcagatgtaggggttgctagactagtgttagcaaaaaattggaaaggagcagttaatactctttctgatatttttgttaccaaatagctccatcttggtttcctcctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcagtgtccctctcttaaaggaatattcttctctcagcctattatccagctttgccaaggatcttctgcactaaagagatggactaacgtaatgactagggttagtatctctttcacaaggcctgcctctcttaatccaaaattggaaaacttgggagtgtctagtattttccatagatactattcaactaattactcagtacaactctgtgcttgttactacggtcaccattttaaaggagaaaaactacttcaaaaaatggatttataagccgaaatttcctcaaggtcacacattgcattatttccaaagcaatgttcatcctgaggttggttgtttccttggtcgcccaggttggagtgcagtggcacgatctcggcttaccgcaacttctgcctcctgtgttcaagcgtttctcctgcctcagcctcccgagtagctgtgataacaggcacgtgccaccatgcctagctaaattttgtattgttaggctgggcgcggtggcttatgcctgtaatcccagcactttgggaggcaaaggctggtggatcacaaggtcaggagatggagaccatcttgggtaacacggtgacaccccgtctctactaaaaatacaaaaacttaagccgggtgtgttgacacgcgcctgtattcccagctactcgggaggctgaggcaggagaatcgcttgaacccagaaggtggaggttgcagtgagctgagatcgagccattgcactccagcctgggcgacagagcgagactctgtctcaaaacaaaaaaaatttgtattcttagtagagacggggtttcactgtgttggccaggctggtctcaaactcttgacctcatgatccacccgcctccgcctcccagtgttcacatatacaggcataaggcaccacgtccagcccgaggttgttatttagatatacctagtggctttatcagaaaaagcaaaacagttcatccactgtaaaaaaaaatagaaacttctgtagcttctcaactggctaaattccagatgattttctaaccactcatcaacaatctatatagcttgccctccacaaaacttactagtttgatgataaaaagcttctgtaatgaggcagttgtccatctcacctgcccaggccacgcagaccctggagttactaacccgcattgcccattaagcatttcttaaacagaactttcaaagatggtagtaattattataaagataaaagaaaactagatgaacactttggaacactgacaggcaggaggaaattaaggacattaccagattagttacagattttcgaaccagtgggatgctgactcaggaactgattggacataaacagtttcactcagaatgagctgttttctatgcacgacactattcaagttactacactccaaccacatttcctctgaacattatttacacaccaaatttcactctggtagcaactaaattttggcacagatgagattaaccactaaaggccacatttgctggtccagttccctagaaagcaatgacacaacaaatttgttaggaagacttggttcaaggggaaaaactgatagcaggagatactttggaaaaagagcacactgacagagtgtctctgccccaaagaactctgcagtctggtattgaaaagtaaattttcaatgaggctgggcgcggtggctcatgcctgtaatcccggcactttgggaggccaaggcggacagatcacttgaggtcagtgtgagaccagccgggctaacaccgtctctgctaaaaatacaaaaattagctgggcacggtggtgcgcacctgtcccagctcttcaggagactgaggtgggagaattgcttgaacctgggagatggagctgagatcacatcactgcactccagcctgggccaaagagcaagactccatctcaaaaagaaaaagaaattgaaccttgggagtttccatacaaattaaatcactagaacaattattgggataaatgtcaaacaaaacgactgatatgaaattctgaataagcctgtaaaacttgtgcttcaatgctaacaaaaaaaaaagttgaacaaatgaggtaaggaactcagtatttgaagataagctaggagcagcatttcctactcaaaagatttaccaagagataaacagttgaagagaattgagtataaatggtgacagcttgcttcccaactagtatgaaagctcaaaaccccttaatacagtaatatatgcaccttatttaatatattaatatataaatcaattttggaaaccagtttgaagttaagccattttgttaagtatgtattgtaaatggtgaaaatttcttcataaatatgcccagacaatgcaggagaccaagaatgcccaggttttaaggccaggctgtttccttttctttttggtaaacccctcagttttgatacattcttctaaaatacacagggctagactctaatagaataaaggaattcatgggggacaacgtgagggcaagtttccgcagactcggaacattttcccaagaggcaagtactgaattgagactaaaagaagctaattctgttctcaaatttctgtaactttaaaacatttgaaaaatgaagatctcctgtggcctttttaagagacttttatttgagtggttcttacaaagattgttgcaatatgaaagtcatttgtttgatagaaatatcaagctgtcttgtcaaacacactgaagtaacccaaaaatatatttcagagctcacagagcttaaaaagagcaaagattatatgcaaccagacaaaacctatttctgcatttcctatttctttctcagactgctttgcctaccagactctcacgtttaaacatcttcaggaaatgcagggatcattttgtttggaattttaagacacaccagaacacatagtatttacaaagaaacttttacagatacattaattgaaaagataccatcaagaaatataattttgaaatctccctttcttgccaattgatcagaatgcaagatgagatgctaaccaaacagccctttagctgtcttgtatttccatacactaaatgtgtatttcagaaactgctcaaccatcagccaaatatcaacattagtgaaatgtgaaatgtaaccactgtgtaaaaagttaggcttctgaaacattaaaaacattacatccctggtctgcctttttacagaaagcacatttgttctcctagagctattcctatagttcattaattttctacatgaacattttaaaaggcagaacaagagaacagttttgtatacagtgggatttactatttagggagaatgagcacactgcattcctgttaacatttttattttttcaaggtaacaggaaattgcatacaaatgacagtagatccttgcctctttatttttatctaaataaaagataactcaagatgaattctcaagaaagaaaaaaagctatatacataagggactatatcttccttcatcgtctacttggaaccagtagctgtgttgctgtcatagaatcaggaaacaggttgtggtaagttggaagaggtacatatgctgctgttatcattttacctattaaaagaaacagacatgttgggtttagcatcttcattatagagccttaataacaatcagtcaaaaaataaattcaaactcaccagcaaaccacctgccatgcaatgcattgacagcagcaatagctgcagcaattgatgggcacttcacatacacattgccctacagaaaaaatgaaaaaaaaggtaaagatgttgctgtatgcaaaatggacccaagttatgtttattcaagttgcctgtagaaacttagtgctctataaccacaaactggtttaccataatggttccactggctaataggtatactagaattttattaaaaaatgacttctactctcaaatttgccgttttatcttttctctacgatttgtatgcagcctaagaatgaatcaagatgccaagatttcatggcaagctttgagcattactagaaatcctctcataccctgatcaaattgttactgattttcttttattttggagggtttatttagccactatattaaagctactttcaggcacacacacacaaaaactataatggaagacggttaaccataacatgcaccacataatgtgcgaagattaaggtagagacgaacaacctaacatcatttataaaaaaagatgaaaatacctgagctgaatttttgtcaacataaatatgaataactcctccatgtttattacattcttcaatcacatcatccttaatctcggtatcccatccaacttcttcttctctgtaagaaagtattaaggactcttaaatactattgaaactaacaaactatatatttacaaatgtatcaaaaaatttaaatattctatgaattaaaaaaaatactttggaaaaaaagcacattgacagaacgtctctgccccaaagaacactgcagtctggtattgaaaaataaattttcaatgaggccgggcgcggtgactcatgcctgtaatcccagcactttgggaggccgaagtgggcagatcaccagagatcaggagtttgagaccagcctggccatgatggagaaatccggtctctactgaaaatccaaaatttagccacgagtggtggcagatgcctgaaatcccagctattcaagaggctgaagcaggagaatcgcttgagcctaggaggctgaggttgcagtgagccagtatcaaatccctgcatgccagcctaggtaactccgtctcaaaaaaaaaaaaaagttaaaagatacagatagggctctggggaaaatcaaagcaaaataagatagaaaatattgatcccatcctactttatgactctgcataacttgaaagtgacttttaaatagttaaatgggccaggcgcagcagctcatgcctgtaatttcagcactttgggaagctgaggcgggcacatcacttgaggtcaggagttcaagaccagcctggccaacatggcgaaaccccagctctactataaaaatacaaaaatcagccaggcatcatggcacacgcctgtaatcccagcactttcggatgctgaagcgagcagatcacttaaggtcaggagttcgagaccagcctggccaacacggcaaaaccctgtctctactaaaaacacaaaagtagttgggcgtggtggtgtgcacttgtaatcccagctactcgaaaggcatgagaactgcttgaacctgggagatggaggttgcagtgagctaagatagagccggtggcgccactatactccaacctagactgagactctggctccaacaaaaaaagttaaatacttcaatgctatcaaatgatacttacaacgaaagtttatcaccatttcatagataaaactaaagtaaatttggtactgggaaaacaaaagaattcaagactctttggatgaaacagtcatacaattgtcattatatgaaatgtaacttattgaaatcgaaacaaaaatctacattttgattggatgtactatattataaatatgatttataaaaccaatgagaagagttaaaaaatagcattctaatcactagctaggcatagttactagcattctaatgctaatagttattagcatcctaatcactagctaggcatagtttccgcacctggccgaaaaattattttaaaaggatcaaaactatgcagtttcaaatgaaatacggaaataccaggccgggcccggtggctcatgcctgtaatcccagcactttggtaggctaaggtgggcggatcacctcaggtcgggagtttgagaccagcctgaccaacatggtgaaaccccatctctactaaaactacaaaattagccaggtgtggtggcgcatgcctgtaatcccagccactcggaaggctgaggcaggagaatcgcttgaacccaggaggcggaggttgcagtaagccaagatcgcgccattgcactccagcctagacaacaagagcgaaactccatcttaaaaaaaaaaaaaaaaaaaaaaaagagaaatatataaaacaactctattgacgccttgataggaaatatcaagaataaagtccattacttacgtttgagggttaaacatgttagagagttggaaacattgtgttgcaagtggctgaacagaggcagctgcagctaaagctgaagctaaaaaaagaaagagaaaaattagtttcatggaaaatgcatgaaagtatccctcataaatactttaaaacgaaaccaaaaacccaccccaagcatgtaactaggatgtcactggagttattttaccttatttaatattgctactaatgtatgttatcagtagcttttaggtgccagaaaactgaggtaacctaatacttgaaacagacattcagaaatttgggagtcctattttaacagggaaattaaactttatgtgttatcaaaatcagttcaattagacaaaatctcaatacacatcaatccaaacagatgaaggataaaatagatttgagtttatacccaaataagaggggataataaaacaaaatcctttgaaatgccaaataaatctatatcctttcctatttcttcgctttctgcccacgaagttttttaaatctacaaattattaaagaattaagacatataaaatcatccaagtgtttaaagacaatgtcctagaaaaataaatcctattaacaatcctattaaaaataaatcctattaataaatcaaatgttttaaaaatgttttcgcacaataaaagaacactgaaaagagcagcatatatgtgtaatatccactactaccaaaacatactggggtttgaagtttaaagagcattttccaagacagttgctccaatgctttcacgtgatttacaaaaatattaccagtagctgttacagaactcaccgtaatcatattatctgaccaaatttcattccaaaacataataacaaacaaagctaaggataaaacagtgcattagaaattatggtaattaaaataaacgatcacttaaagtatcagaaatattacaccgagaaattagggctgtgcatgaaatatatcataaatgataactttctggtagcattacaggtgctttagcttctctgtaacatataagttttttctttcataaagttttattttaaataaaacaaaattttaatataacatgtcaaattctgctggaaaaaagttaaagattcgagagtgtattataactgtgcaaaaatgaagctcactgtgtagcttacagaagatatggaagtatccttaaaaaaaactagaaagtctaaacagaactgaggaagacttgattcttccagtttctcaagtttagtatgattatatactatgaatactaaaaaatattaagaaaacgtactatacaaacattcacgttcaagctagatcaatgcagaacacagtaaatctaggaaaatcttttaaaaatctcttaacaaaacagcactgattagaagcatcttgtttgtgaaaaaatttaattcttgactgtgatggaacatgacatatctttctcataatcatttccctaaacattaagcatactcctacaaaagatatagaacttacattaacagcaaaatgctcatgtcaagcaacagagatttagtgataactaaaaacaagaaatcatagcctacttaatgaatggtttctctgaaatgtgcatgtaatttaagtatgtataaacctcttattgcttggtactggcttaaataaatcactgagtactatgtcttaagcaaaaaaaggtgagttttatagcatgattcacaactttatactaagacaacttccagattccaggttctaaaatacttgcctactcgttaataagagaatacttcatttcctgacttctatatgcaacttatcaacacttagaacacacaggtaggcataaaacaaaaacaaggttgaaaattttaagcaaactaaagcaaaaaaaaaaattgttattttgattttttttaagtccattaatttgggttaggtcttctgaaatacagacagattactatgaatataccactatgtgtcactgtgtcaaaatttggtccaaattactggtataaaaatatgacaataaatatagaaaactgtcttactacatttaattctatttcaaagacaaaaataaaaaatatgaacacttcaactcaccttcagtctgctgggaaagtcttgtttgcaaatctataacaaaagagaattctacagctcagtgcaggaacaatgaagagcctcaactaacagggtaaatgtcaggaaagcattaataaaagaggactacaatagcagggttcattcaaatgcacttagtaaaacctggcagcaaaacctccttccccattcctcattgagaaggctttggggccttttttccccctcttatcctgggaaacttacttttccctctctcttcctagactagactactcttccacatctcaagtgattttcactacactactatacagctgggaataatgggaaatggggaaagggaagcacaccggtcagaaaatgagtgaaaaaccctgatcttgagaattcaattccaagtacttgggaaatgcaagtatttatatttttagtggccatagtacttaacactttaaaaggatattataaaattgtaaatactgcacatcaaaaagctgtaacagtttccatgatttcccaatttaggaagaacatcaccattgggaaatacaccattccaacagtatgcatatattatttttttaaggacttttcaaagatttaacttgtcaaatctagcccataatggggcaacttgattattgatttcctggcctagtgtaaaaatttagcaaggcagaaataaaaatctctggagttttcttaaaagctatgaagtttaggaaaatgaaaacatctaatcagtattaaaaataagagggatgtgaccaatatattttctcatataatcgttagatttctacagtggacgccatctgaaagctgctacagagtgaaacagtagcaagtctgaacagtaagtctgccacagtgctataatgctctcttgaagttctttttatagaaatatatgacatcaaaattttgattcagtaacctgattttcattaaaatttgattcaactgcaacactttattaccacatatatgggtttcttgcaacatgggcaaaaatgtacagggatctgcagcccaagttatattgggataaaatacctgggtcctaggtgctcaaaattggcatctcagggagctgaagaaatgtaactggtgtatactgaaggaacttgaagataggaccatgtgaacagtgtcaataaactttaaataataacagaatttgtcttttttttcctaaaatgggaaaaaatgtatagatatcagaaatccatgctattttgtctaccaacccaatcataatttcaaaaatgatttgtcatatcatttgtgacaaagtgaaaaataaagcatggttttcataaagataaggactctaacctattttagaaagggcctatcaaactggcagaataaaataatgtggatatagtgatgacccatccctagtttcacccaatagctttaaaagacttaggggacaagcacctcaaacacagtaaacactcaacaattttatttcagcaagttatatgtaatattttaatgaccaccatctggagaaaaatatccagttacacagatattcacctaaaacatgagtgttattaatgcagaagaaatttatagcaaggctaataaaacagaatgatctttaaaatcatctctaccaccaccagcactaaaaaagggaatgtaactagatacatagataaagggtagggacactattgtcaggaatccatatggagctttaggattttagctggctacattcaaacaatcttaatatatactacacgatgagaaagaacccaagaggtacattcatccataataaaagaaataaaggctaacggtagaactgatatttaacagtggataatcttcagttaactgaagacattaagagcaaatcaacgtatctgatacagcatccagggtgtaagaaaattgtctataaatgacccctttgtcactgtatcaattccctgaaggcaggaagaaatctttcaccaccctttagtggaatacctagaacatgaactaaaaattttcttagttgtcaaagaacattatgaacaatgagaagcaatacaggtaaacagttttctggttaaaaaaaaacctttcaaactgtaataataaactctaggtaatgagtttactatcaattagagcaagtagcaatcgacaattactcactgtaaaggatcgaatagctaacactataagctcaaaataaattatgtgttaatccaatggaataaagataacttgaggagggatcaaatgactgttaaatacacaaatgccttactggttctgattcttgtaagtataaactggcttcgctgtcagaaattctagggagtaactgcttgtcaaatttcaaaataagtcatacaatttatagaaaggaaatgaaaccaaatgcaggttttctaaaggtactcacacacttaagaacaaccactaagaaggcaaaacagtgaaaaaataaatgtaaaaacaaaagtcgtcttctactttaattgaatattgagctttcaatttagaagaaaatcatgaagcaaccacaggacctcttcgtactttcagatgtggtactaccagggtctaaaatctatcttctcagttacagtctcacttcgtatatatatataaggtcaaaggaccagccaggtgagggggctcatgcctgtaacccaggattttgggaggtcaaggcaggcaggtctctactaaaaatacaaaaattagctgggtgtggtgggaaatgtctgtgatcccagctatgtgggaggctgaggcaccagaattccttgaacccaggaggaagaggttgagccacagagtgagactccatcccccaccaacaaaataacaaaaggttcttcttatgatgttctaaaagcacgtctttgacatttcaaaattagatcctatcctatctcccagatttgggtcaatgtaaaagttacaggtaattaagaaatgagggccgaacgcagtggctcacatctgtaagcccagcactttgagaggccaaggtgggcagatcacttgaggtaaggtgtttaagactagcctggccaacatggtgaaaccccatctctactaaaaatatccctgctacttgggaggctgaggcacgagaactgcttgaacccaggaggcacaggttgcagtgagccgagactgcaccactgcactccagcctgggcaacagagcaagtctactgttatccaaaaaaaaaaaaaaaaaaaaaaaagggggcggggggttggggggcacaggggaatgagtgttttatgaactaaatccctttatacataattgtaaaaacgtcaattcacccttcttttcctgttgcctccaaaagctccacctcccaattcatgatcttaaatttttatgtactataaagaaaaataactgtctcaacactcttactactacaatagttttaagtaaagcttttttaagtgcctctgatattttctaaattctaatattataaatattttttcgatcaaacaatatacaccttgtagtattcaataaaactgatatatttgaaaataaacttatgtcaatgaatttcgactaaaaactggggtgcagggtttaaaactgtcctgacaactcattttgatgcatggttaattctaccctatgtctccacttccttaaatagaagactacaaactaacaggctataagtacttgatgaattgaattctcagtaagtccttttaaatgtaaaaatttggaaaattttcgaattagatgaaaaaacgatttaaaattagaaaagattcaattcctacctgccacagcaccaaatgccaaagagccactcatctgtagagcttgctgtgctgctggcggaatctgcaaacctgtacctgtaaaagaatagtcttaaagttcctactatgttgagagcagagaaacgaagtttcctgggtcattaatatcatgatcacttcactaaaataaattgcaaggagggccgagtgtggtggttgacgcctgtaacttagctagcactctgggaggccaagggaggtggttcacttaaatcccagagatcgagaccaacctgggcaacaattgtgaaactctcttttttttttgagatggagtatcgctcttgttgcacaggctcttgttgcacaggctggagtgcaatggcgcaatctcggctcactgcaacctccccctcccaagttcaagtgattctcctgcctcagcctcctgagtagctgggattacaggtatgcgccaccatgaccggctaattttttatttttagcagagatagggtttctccgtgctggtcaggctggtctcgaactcctgaacttaggtgatccacccgccacagcctcccaaactgctgggattacagttgtaagctaccgcacccggcagaaaccccatctcttaaaaacaaccaaccaaccaaccaacacaaaaaaaaaaaaaaaaaaaaaaaaaaaaaaaccaccacagaaattagccaggcgtggtggtggttgtttgcaactgttagtcccagctatttagagattagggtgggaggatggcttcagccaaagaggcagaggttgcggtgagccaggatcgcacaactgcactccaaattgggcaacagagccagaccctgcatcaaaaaataagaaattacaaaaagaaaaacttgtaacattataatagctgcaactaaatttattcctaagtatgacatataaacactacataaaggaaaagaaatcttgcaacttatactgtggcattcaaaacacataatatagatttccatacattaatacaaggcacatcatctataaaataatatgcagtgtgaccaaggataacgccaactacaaaataagataaaatctttttccctttcttagtttacatggctacctttcttttccactacaatacccacagtaaatcattcgtaatagcaagaaacacttaccctctgcaagtcttgccattaactgaagacgaccagttgttcccaaatcaattccagtcctttccagttcatcactgtccaaaaatgaactagcactcgaagcatcagtacgttcagtaacatgaccaactttcattggtcttcctgctagttcaaatccattaagttgttccaaagcctttttggcacattctgagtcagaaaactacatgataggggaggcaaggacaggagacagtgctttaatttttaaaatacaaactatacttaaaaatatatttatatttttagcatattcaataattacttctgaatactaaggtagaaactgcaagctgtaagtagcaaacacaacatacatgatgacgacgctagctaacgcaaattaggcttgttgatgtggtagtttaaataaaagatattacaagtaatgacagctttatatttgagaacatggggattgtggttagaaaatgtgaaaactggctgggtgcagtggctcacacctgtaatctcaacacttggagaggccgaggcaggcagaccacctgaggtagaatttagtacttttctaacaaaaatgtgcccagggacaaaatagtcaatataatcctcatatataaaacataaatacttcatacacaagcaaataaatacataacttgatataaattacatatatataaaattttggtttacacatatacccacaatggcttatctggagaaaaagaaaaggtggaaaatatccacactaaagttactagaataaaaaaataaaattggtgagctatgtttcataaattttctcctttcaccagttcattgacgtacgtaacagcctaatgaccagtaagttaaacagatttgctatcaacatagcaacaggcttacattttattgaaatgtagatataagctaacaattttaatttcctgatagagatatacagtgtacttttaaaaatactatgtttccaggaccttaaaaggttacagagctcacacatctgaaaaaagttccaccatggatgagtttcatatacatgagtggcaccatctcggctcattgcaacctctgcctcctaggtttaggcaattcttcctcatcctccctagatgctaggattataggcgcccgccaccacgcccggttaattttttatatttttagtagagacaaggttgcaccatgttggccaggatggtcttgatctcctgacctcaggtgatctaccgctctcagcctcccaaagtgctggcatcacaggcgtgagccaccacacacagcccaaaaacacttttgacaagacaattctggtcttggttgtgaggtatgtacattaaaaaaaggatctttagtaaaaaagaatcgttaacagaccttcatttatttaactgttaagaatgtgtcaaaaggttatcagagatgaacgtataaaacattcaattatatgaatagctggctgacccctatatgtatatatagcacatagtaaaggaaaataggaacacagtaatataatttggatccttgtcccctctaaacctcaggttgaaatgtgatccccactgtggaaagtgtgacttggcaagaggtatgacaaggcagatccctcatgaatggcttggtgcactccccctgctaataggcgagggtccttgctctgttacttcacaggatgtcttcctctctcttcctctccctctctccaagtgacacacctgctcctccaagcaataacaagtaaaggctttgcgaagcacaagtaacagcttcctgaggccaccacagactctgagcagctgttagtgtcatgtttgcatggcctgcagaacctaataaacctattttcttaaattattttatatttatttatttatagttttattttttttcaaggcagagtcttactctgttgcccaggctggagcactgcagcgcaatagcacaatcttggctcactgcaatctccatatcctgggttcaagcaattctcctgcctcagcctcacaagtaggtgggattacagttgagcaccaccatgcttggctaatttttgtatttttactagagacggggtttcgccatgttggccaggctggtctcaaactcctaatctcaggtgatccacccgcctcggcctcccaaagtgctgggattacaggcataagccaccgcgcccggccacaaaaactaatttaaagcacttgaaaatattaaacatgccaccttccccaccattattaactattattgtacttctactatgcaacttggatcaaaaaattttaggagtacctaagtgtgatgatttggttttcacattcatgtgtgagctgtgcctgccttttgttacaagggcatattaccctttgttgtgaaaaaaacttttttgatcggacacagaggctcagtcctgtaatcccagcagtttggaaggctaaggtgggacatcatttaaggccaggagctagagactaatctgagcaacacagcaaatgtagtttaaaaaaaaaaaaaccctaagtaatataattatggtaattacttactgtaataaatccatatcccttggatcgaccagtttcactgtccatcatcagctggatactttcaatctataattgaaaagcataattactataacttaaaagcagagtacaaaactactttcttccctgagacatggttttaaaaatctaccagtctcctcatcctccaaaatagaagacttatcacaaaacctcatcaccaagaagtcttttttaagtctagaaactataattttatatgtaaaatgaaaaaaattaggctgggcgtggtggtcggcgcctgtaatcccagcattttgggaggttgagggaggcggatcacctgaggtcaggagtttgggaccagcctggccaacatgacgaaatcaggtctccaccaaaaatacaaaaattgtctgggcttggtggcgcatgcctgtacgcccagctacttggaatgctgaagcagaagaattgcttgaacccgggaggcagaggttgcaatgaccccagagcacgccactgtactccagcctggacaacagagcgagacttggtctcaaaaaacaaaacaaaaacaaaaaaaaaaaacaaactctagaaacttcccaagcgagaaattatgcactggggagcagaggggagaaaaaaaaactatgattgtaacctaagattaatttttatatcaatactaaaccactgaaaaccagaaatccttcgtaaattaccaatagaaggtagaaacaaaatcaacgtttccttcccattgtgctaaaaacaccaagcagtaatttccaattataccagacagaatcgtaaaaatggaatgaatttggcaatatacaatgaatttggcaataactgcacaattctgtgaattgtactaactaaaaaccattgagtttacgttcaatcagtgaactgtaacacaatctcctgatttagctgtccatttaaaaaaaggtatgaaaaattaaaacagagcatccagccaggtgggttggctcaggtctgtaatccgagcactttgggaggcaggaggatcgcatgttaaggaggtggacgctacacagtgagcttgcatcatgctgttgcactccagcctcagtcacagagggagactctgtctcaaacaagaaaggaactttttttttttttgagacggagtctcgctctgtggcgcaggctggagtgcagtggtgtgatcttggctcactgcgagctctgcctcccgggttcacaccattctcctgcctcagcctcccaagtagctgggactacaggcacccaccaccacgcccagctaaattttttgtatttttagtatagacggggtttcaccgagtttgccaggatggtcttgatctcctgacctcgtgatccacccgcctcggcctcccaaagtgctgggattacaggcatgagccactgcgcccagcccaaggaacgaacttttaatgttaagtatattttaccaaaattttaaaaaagaaacaaagtttatttgctagtatttgctaagccacagaaagtctatggaaggatataaaaaacaaaacaaaacaaaaaaaaaacgggtaagggctgcctctagaaaaggagtagtcgtggatgaagtgggactatgatagggataagatattctaggagcattagctagcaaaaagtaaacaatataaacatttaggctgggctcggtggctcccacctgtaggtgtgagctgacatgggcagactatctgagctcaggagttcgagaccagcctgggcaccacggtgaaaccctgtctctactaaaacacaaaaaagtaggttgggctccgtgactcatgcctgtaatcccaccactttgggaggccgaggagggcgaatcaccagaggtcaggagtttgagaccagcctgaccaacatggagaaaaaccctgtctctactaaaaatacaaaattagcagggtgtggtgccgcatgcctgtaatcccagctacttgggaggctgaggcaggagaatcgcttgaacctgggagatgggggttatggtgagctgagatcatgccattgcactccagcctgggcaacaagagcaatactccatctcaaaaaaaaaaaaaaaaaaaaaaagccaggcatggcggcatgcacctataatcccagctgctagggaagctgtagaagaattgcttgaacctgggaggcagaggttgcagtgagctatcgcactccagcctgggtgacagcgcaggactcagactccaaaaaaaataataaaataaacctttaaaaagggcttcttattaaagctgctacattatgtttactggagttgggcacttaatgcatactaattgttctggggcaaaggtaagcaaactacatataccccatgaaccaactccagcttgacttgttttataaatctttctcctgtctgagcctccagagtaagctggaactacaggcatatgccacccaagaccggctaatttttatatttttagtagagaagaggtttcaccatgctggccagactggtctcgaactcctcacctcaagtgatccacccgactcggcccccaaaagtgcagggatcacaggcatgagccactgtgcctggcccatactcaatttcttaatagcttacagctgtttggaagagagttgagtacttgcaacaagaccatatggcactgaaaacctaaaatgggtctgggcgcagtggctcacgcctgtaatgacaacactttgggacaccgaggcgggtagatcacctgaggtcaagagttcgagaccaacctgaccaacacaccaaaaattagctgggcgttgtggtcagagcctgtaatcccagctactcaggaggctgaggcaggagaatcaattgaacctgggaggcggaggttgcagtgagccgagactgcaccactgcactccagcctaggcgcaaggagtgaaactcccatctcaaaatttaagaaatagtttgacaaatcagactctagagtaataaaaataatttaaatatcaactgtttcctgatgttaatttttatatggtacacagatttctcaaatatccatgattattctttttcttttctttcggagacactctggctctgttatccaggcgtgatctcggctcactgcaatctctgccacccgggttcaagtgactctcctgcctcagcctcttaagtagctgggattagagggatgcgccaccacacccacctaatttttctatttttagtagagacaaggttttaccacgttggccaagctggtctcaaactcctgacctcaagcgatccacttgcctcggcctcccaaacaaagagatgggattacaggtgtgagccactgcacctggccagtgaatatatttttaaaagttaaattttatttgttctatctagctccttttaaatttatgccttttgctaaaattattgagtggaaaaggttcattcctcacagtgacaggacagtcttggcaactttctctcctcaacacagaactagttggacactcttggtttaggtagatagcacaaagtcctctagaacaaaagccaagctgctctgaattgagctcaagaccacaatgccagacacaaggcctcgtggcgcctgtgaagcagatcaagttggttcctcactttgccatgtaacagctcatgtggccccaactgctctgaacttcatttctccatatagcacataatggcatgtcaacctccacctaagatccatgttactgatagaaaagtcaatggaggccaggtccagtggctcacacctgtaatcccagcactttaggaggccgaagcagatcacctgaggtcaggagtatgagaccaacttggccaacatggtaaagccctgtctctaaaaaaaaaaaaaaaaattagtcgagcatgatggcaggcacctgtaaacccaactactcggaaggctaaagcaagagaatcgcttgaacacagagaggaggagtttgcagcgaggcgagattgtgccactgcactccagcctgggcagcagaataagactctgtctcaaaaagtcaatggagaaagtaccagagtggatcagaagtgggtcacatactgttaggcagaacagccttgccagaggggcattcacccactgaagatttcaacagacagaaaaagggcaaatctaatcaggctaccaaggcctggaactgagcacataaccagggagacagagtaatgtctttttaaaggtaagggtctcgccaggccaggctggagtgcagtggtgccatcccagctcactgcaacctctgcctcctatattcaagggagaaattctgctgcctcggcctcccgagtagctgggaacacagagacgcaccaacacgcccagctaatttttgtatttttaacagagacgtggttttaccatgttggccaggatggtcttgatctcataatctgcccacctcggcctccctcccaaaatgctggggttacaggtgtgagccaccgcacccggccaacagaaaagaatcttaagatattcaactttcttttaaaaacaatcttttaaaaaaaatcctactaaaaaataatagtcttcgtatgatttaacaattttccttcttttgacacaggatcacactgttacccaaggtggagtgaagtggcataatcatggctcactgcaaccttgaaatcctgggctaatgtcatcctcctgcctcagcaccccaagtagctgggattacaggcatgagccaccatgcccagccaatgtggactttttattaactctaatacccattatgcatttcacatggcattatgaataacagtaacattcttttaagaatctatcaagtgacctattttaatctatgttgtcacagaaatttttataaaaccagcccttatcctcttaatattaactcacagaaagataacaaagcaagacatacagaaattatgtagttatactcagatcaacaacctactgaagattcattgaagaacctggacttactcttccaaaaggctcaaagatcccacgaagcatatcttcagttatgttgaagtgtaatgagcccacataaagcctcataggtccagcacttcccttttgtaaattgtttgccattgctgcagctctgtttttttctgcctagaagacaaaatacacgtcacacagagataacacacagcagtttaaagacatacaccttccatttgcataacaactaatgttaaagtttagagtgataaaaatactaccctacgtaagtcagatactacatatcaacttaataggaggcatctagaatatgcaaaattcagaaagaggaggtagataacattttaccaagggcctgcaggaaattagggagttacagcttcaagagtacagtttttggctgggcacgatggctcacacctgtaatcccagcactttagtaggctaaagcagccagatcacgacatcaagagatcaagaccatactggctaacacagtgaaacaccatctctaccaaatatagaaaaaattagccgggtgcggtggtgggcacctgtagtcccagctactcaggaggctgaggcaggagaatggcatgaacccaggaggcagagcttgcagtgagacgagatcacaccactgcactccagcctgggtgacagagtgagactcagtctcaaaaaaaataaaaataaaaaaaaaaataaaaataaaaagtttatttagaggcttttttttttttttttttgagacagtctcacactatgttgcccaagctggtcttgaactcctaaacttaagtgatcatccttccttctcatccactagagactgccagggactacagcacaccccacatcataccctgcttattttagaatgttttcagagcacatgccagtcacatataaagtaagcaggctggccgggtgcagtgtctcacgcctgtaatcctagcactttgggaggccgaggcggacggatcacgaggtcaggagatcaagaccatcctggttaacacagtgaaaccccgtctctactaaaaatacaaaaaaattagccgggcgtggtggcaggcacctgtagtctcagctacttgagagactcaggcaggagaatggcgtgaacccaggagacggagcttgcagtgagccaagatcgccccactgcactacagcctgggcgacagagcgagactccgtctcaagagaaaaaaaaaaaaaaaagtaagcaggctacatttcacacctaaaatgaatcatgaacctacattcttgacaacaatcttaagatgcattctgataccacaaatactaaatacagagaaaaatgcttcctggaattgttagacacaaccaacattcactaaaatactcttgagattggtataaccgaacgtagttgtttgtgataaaataaggtgtatatgccataacataaaactgtatcaccaagcaaacattttgagtcagctgtcatccctccataaccaagatcgcctcaaaaaaaaaaaaaaagaaaagttgtccatttgcattctaacacaggcttctcttgtaacaaactagagtacattggatagtactgctctacaacaggttgctgcatgaatttaaaacctcacttaatatgctacttctcagccctgggtcccgccaatgcacacccagccactaagtttgtcttccaacataggaaataatttgagtaactcttttttctttttgagacacagtcttggttcttgtcgcccaggctgcagtgcaatggcgtgatcttgcctcactgcaacctctgcctcctgggtttaagcaattctcctgcctcggcctcctgagtagctgggattacaagtgcctgacaccatgcccagctaatttttgcattttagtagagacaaggtttcaccatgttggccaggctggtctcgaactcctgacctcaggtgatccgcccgcctcaacctcccaaagtgctgggattacaggcatgagccatcgcgcccagccaaaatactaaaatattaaatgctgtcaaagcgctgtgcggctcaagtgatcctaacacttcaggaggcccaggccagaggatcacttgagcatgacagtttgaaaccagcctgagcaacatggcaagaccctgtttcttaaaaaaatttaaaaattagctgggagtggtggcacgcacctgtagacctagctactcaggagactggggagaaaagactgcttgagcccagcaggtcaaggctacagtgagctgtgattatctcactgcactccagccctggcaacagaagtgagaccctatctcaaaaacaaggccaggtgtggtggctcacaactgtaatctcagcactttggaaggctggggcaggtggatcacctgaggtcaggagttcaatactagcctggccaacatgatgaaaccccatctctactaaaaacacaaaaagtagccgaacgtggtggcaggctcctgtaatcccagctactcaggaggctgaggcaggagaatcgcttgaacccaggaggtggaggttgcagtgagcagcgatcatgccattgcactccagcctggtgagagagactccatctcaaaaacaaaacaaaaaaaaggcaaaatcattacatttcaaacacaaggagaaacgacaggacgacagtcttgagaaaactgtatcaatgttaataaacgcaaagttaaaaaaaaaaaaaaagtcctgaaaacatccgactcaacgtaatgagcagcagtcacagaacacaacagcactataccatgcaacaggaggctttcaacaccaccaataatcaaactcttaaccaacaaaaaaattacctgtgatgcctgtactatgattggcacgcctaaaactcgttggccagttaatcctattgctagaggcactgagctaacatcgacgaactccacataagcaattcctttggaacgtcttgaatttctgtcagaaatcatcctcacatctcgaacctagaaagaaaacacagttgtttgtgcaaacatccattgtaacacatgtagaattatttcaagagacactgttgaaggatgaaggtatttttaaaaatttaattaaaaaagtaaatctgtaggacaattcctatatcctatctttatctttgaacaaatttgtagtaacatttatcaactccaatactacaagaggcaaaatggaaacattaccacaaacaaatactgctactaaatcaaatgaagtatttgatgtttacatgttttctcttgcaatttctacctacttgacctccctaaacaggttaagattacctttcctactgtagagaaaaactcttccaaatcccttggtcgaattcttgccgccagctgcatacagaagactgtccttgcatctctttcctcaggagttaaattatcaataggttctctaataggagtaaaacatataaaattaatttcataacagattttaaaataatttttatcttttttatttcttcatatagttcaacaggttttcaggtacaggtgggttttggttacatagatgagttctttaatggtgaattctgagattttagtgtacctgtcacctgagcagtatatactgtaccctcactcctttcccaactccacaacaatatttccatctttagaaaccaggtcttgctatgctgcacaagttggtcttgaactactgatctcaagcaatccttttgccctaaactcccccatagctacggcatttcaccatgttaactaggctggtctcgaactcctgacctcagatgatccgcctgccttggcctcccaaagtggtgggataacaggtgtgagccactacgcctggcctaaaataattctcaaacatgttcagtaaacagagtaagctgtgaaactggtttgtcataattcccaaacccattttcttttttttttttttttttttccagaggaagtcttgttcttgtcccccaggcttggagtgcaacggcgccatcttggctcaccacaacctccgcctccctgagttcaagcaattctgctgcctcagcctcctgagtagctgggactacaggcgcctgccaccacacccagctaatttttgtattttaagtagagatgtggtttcaccatgttggccaggctggtctccaacttttgatctcaggtgatgtgcccgcctcggcctcccaaagtgctgggattacaggcatgaggcaccgcacccggccaacccaagcccattttcagtaagatctattgacaaaaaatgcgcataaaactattcaatgtaactcaattccttctaaaaactaaggtttactgtttcttgtaatcacatcttacatggcattagcacagaagtctactggccttaccatctcaaaaaaagtaatttttcttttctttttttgtttttgagatggagtctcactgtcactcaggctggagtgcagtggcgcaatctcggctcactgcaacctccgcctccagggttcaagcaattcttctgcctcagcctcccgagtagctgggactacaggtgtgtgccaccatgcctggctaattttctgtatttttagtagacatgggattccactgtgttagccaggatggtcttgatctcctgatctcgtgatccacccgcctcggcctccaaaagtactcggattgtaggcgtcagccaccacgcctggcccaaaaagggtaatttttctaaaacaagggtcaaccagaagcctgacagtttaatcatagtcataaaacatatcaccagaccaatcacaaatgccagactgatccaaaatcagtgtaatggatgattctttacaacaaaaccatgtaattgtaaagtcaaattaagtttgacaatcacaaatggcaaacttgaagtgaaaccccaaatgattctacaaattctactttacaaatttagatacagtgtctattaacatcatctctgttacaaaatatcaattaaggttgtaagtcatcctttaagatgtaagcctaaacacgatcttttccattttttggacactctcaggatgtacgggggttggggtggtcgctccacctgtaagatttgtcacaaaagcttttttttctttttggaaacgcagtctagctgtcacccaggctggagtgcagtggtgtgatcttggctcatcacaacctccatctcacgggttcaagcaattctcctgcctctcttcccgagtaactgggattacacgcacgcgccactacatccggctaatttttgtactttattagtagagatggggtttcaccatgttggtcaggctggtctcgatatcctgaccttattgttacaggcatgagccaccacgccaggcacaaaagcttttaaggccgggagtagcgtgcagattgcttggccctggattttcagaccaactgagcaacatggcaaaaccttgtctctacaaaaaaaaaatagaaaaattagcagggcatggtggctgcacctatagtcccagctactcgggaggctaacctgggtgggattgcttatgaccggccattagaaactgcagtgagacatgattgcgtcactgcactatagcctgggtgacaaagagaaaccctacctcaaaaaataaaaaataaaaataaaaaagcaaatgctttctagccgggggtctcaaaaaaaaaaaaaaacacccacaatgctaccacctgacaaaatattccttgaaccgaaatcgtagactgaacaaatacagttccctttttttttgtagacagtcttgctctgtcaccaggctggagagcagtggcgcaatctcagcttactgcaacccttgcctcctgggttcaagtgattctcttgcctcagcatcccaagtagctgggactacaggtgcacaccaccatgcccagctaatttttgtattttttttttttttttgagacagagtttcgctcttgttgcccaggctggagtgcaatggcgcgatctcggctcactgcaacctccgcctcttgggttcaagcgattctcctgcctcagcctcccgagtagctgggatgacaggtgcacaccaccacgcccagctaattttttgtattttttagtacagacagggtttcaccatggccaggctggtcttgaacttctgacctcaggtgatccgcctgcctcggccttccagagtgctgggattacaggcgtgagccaccaccacgcctggcctaatttttgtagttttagtagaggcagggtttcaccatgttagccaggctggtctcgatctcttgaccttgtggatccacccacctcagtctcccaaagtgctgggattacccgcgtgagccaccgggcctggcctacaattcttatttttaagagtaaaataatccatggaaacttcattgaagaacctaggagtaacaattcaaatcactaagacttctgagatgaaatagttttcctcaggacagccaaatagtaaaacttactgttacaactacttctccacgaggctatttcaaataactcattatttattaattccaaagttaagtgtaaagtttgatataactgctacgttgccaacacaaagaaacatttaacacgaataagctaattacccgatttgatcattacactgtatacatgtatcaaaacgtaactgtattacccatatacataatcattacatgtccattaaaaataataaatgcaaaaagtttattttaattaaaataggaaaataagattacattaaaataactttagactgggagtggtggctcctgcctgtaatcccagcactttgggaggctgaggagggcagatcatgagctcaggagttcaagaccagcctgaccaacatggtgaaaccccgtctctacttaaaatacaaaaatttgccgggcattgtggcacatgcctgtactcccagctactcgggaggctgaggcaggagaatcacttgaacccaggaggcagaggttgcagtgagccgagatcccaccactgcactccagcctgggtgacagagcgagactccatctcataaataaataacttttgtggccgggtgtgttggctcacacctgcaatcctaccactttgagaggccaaggtgggtggaccatctgaggtccggagctcaacactaggctagccaacatggtgaaatcccatcgctactaaaataaaaaaatagcgaggcatggtggtgcatgcctgtaatcccagctacttggagggctgaggtagaagaactgcttgaacccaggaggcggaggttgcagtaagccaagactgcactactgcactccatcctgggtgactgagtgagactccgtctcaaaataaataaataaataaataaataaatatataactgttgctttaattatatgaaattaaagtgaaaactactgaaaactcagtagaaattcacttgaccttaaagtactggaagtgcaaaagaaagcaaaagcaagatttaatatggtccaaattactaaatatcatcaaatttaacagtaccataagctgcaaaagctttttaagagctaaaggctttaaagaagtaaactacctcacagggctcttgtcttttctgaatggacttttgcttcgggaacgtcgtctgctgcaaagttaaaaagtttcagaagttatccaaacaagtacagcatgttagttccttgaaaaacaatttaaacaattcagaagtatgtttaaaaaccttaatttgatgctatgaggcaacccaatctttcctcggatggcactgttaaattttggtccggagctaaaaaggaaacacaaaattacactagttacaggtttagggtcttgctaagatcgcattcatgcgctctccagcaagactaacattgtttaggctactgcttttccacctcagttatgaagaggaaacaaaaatacttgtctcttaactttattcccaggcaagctgcccttgtatttatccatcctggaccactgagaggtgccaagaccaaaggttacagcctcaaaatttttagattctgaaaatgcacacacccattttcagactttagatatctttgtaagctacatatatatatacagtcttgagaattaaaaaaaaaaaaacacacacacacatatataaaaaataaatccctctgaacttccctcacaccagcagtaactatggttaacaatttggtgtgtatctttgcagatcctctcttgggaatctatgtgtgtacatgtacatatacaattttcatatacatcttctttttgaaagacttcttttaaaaactaaagtgaattctttagtcatgcaacttaggtatttccccattcaccagtaactcttaagacagcatgacaccacttaacacactacatacttcagttgtttgttgcaaaaatattccatcgtgaacatgtgaaggtaatttaccaattctctagaaaaattttgtgaggacttgtcaggactaacagagtgttttcacaaagatcataaaggtaattattctgtagtaacagtttttgtgactttttaaagaccaggctaacttaaagggactagccagttgtccattagtgctcatcctgctaacttattccagaagaacagcgaaataaataaatacatagtggcctgtgatccacacatttgaattagttttcatgaacaccatgcctacctacaacatgcaagtatttccaaataaaacactttatattaacttgaccctttgcaattcagactaatgctgatgactgagaatcatttactggatgtattacagttctcaagtaattagttataagctattttctttcccctttaattataaaatattctgagttacagcctcaaacccaacattaagaactaagtaattttttattaaagttaagccatgatcccagcaaacaaagtatccatcactcaaaggaattaagctaattcctttccccttatttagttcatcctggtaaaaagatttaacataatcccattttaaaaatgctcagaatcttgataaatgggacaaaagcagagaagttcctaatgttgtacagcattcgaaattaaaatagcattgtggtcccattttcagctattaaaaagttaatgaaataagcagcttggaggaaaccagcatcacggagtttaattctttttattttaaagataaaagagccagaatcggaattcatgtaatgccaaaacatttcatgaatccattaagtcctctgagcactttacattttcttctcattcattactcattaatagcttatctgaaacttattatctccttaaaaggttagaaaacaaatgcttagcttaggggattaagtatcttgcccaagtgattcgggtctgtttgtctttgaattccatccttaaccattcaaatcttagaagttagaagggttatttttaatatatcccagagtttacagcactgtgtttattaagaggaattaacctcataaagcattaaagattgctagatgcaatccttagaattgtaggtggttaatatagttatttaataaccataatatatttgtttccaactttaaatatccacatccaaatttctagtgatctaatcttcaaaacacttttagtttggaataccttttattattattaacaaaccttaaatacagatgagcccaaaaaaggatctttatcaatgagcatacacaacaaattcacaactggcctgacatttcagctgaaaacagccacggtgacagactttttatttactgttaactaattatacatgtgtaacttagtattcatcagaactttacaattttaagtaaatatgtatttagcaaatactgtaacagcccagacacttgttaagctttcttaggtatttgggcactacaatgtcatctttttcaagcactctagtgctttcatccagtttgcgttgactggcatacaatttagaaactctgatagtttaacagaaaatagtcagtatgcctagtaaaagcaaatttttacttatttgtctatgcactgtattttcactttactagtattcaatgccaatatccttaattcaatactttttaaccaatcattaaaaaaataaaaattcacaattcaaatcactcaagttaaactgccatctgaatacccagagaataaccctcaaaccaaaatcataactatagttacatactaaggacttctgtagcggcctctaaatcttcgatctcgacttcttgagcggctccgtcgcctctctttgcttctacttcgctttctttcacggcttttgctctttttcctttctctgtctctacttcgcttccgttccttacttttgcttctctttcgttcatgactacgacttctgctcttgctttttttcctcctgagaagaaaaaaactcgccattatcatgctggcttaagaacccaccaaaatatactaccttttatggccagaatcattttttcatcctttcataaatttctttggctagttttactatgatacaatggtacataatcatacttaaaaaaaaaaaaaaatcctgtaatctcagcactttggtaggccgaggcaggcagatcacaaggtcaggagttcaagaccagtctggccaatgtagtgaaaccccgtccctaataaaaatacaaaaattagccgggcatagtaccgtgcgcctgtagtcccagctactcgggaggctaaggcaggagaattgctcaaacccgggaagcggaggttgcagtgagccaagatcccgccactggtactccagcctgggcgacagagtaagactctgtctaaaaaaattgctacgtatagtaaacaatatcccttttgccttatattaacattactgaaaatcagcagacaagacattatttgaaagacaccatcctctaagagtagaactgcaattatctcctgagagttagctatagctttaacaagcaaaagggcttgttggcaaatacaaatcaaaatgtgaacctttaaatagtttgtcatacaacaggccaacaaaagcattactgtaatccacaaaataaattaataaaacaaacttacaatagaatattttcacattcaagtactagtactggttcatttataaaaattttcatcaaatatagtaatttaccattaagtcaattttgcccccatttacatatggaaatatttaacacgttcaaagggtcacatagacatcaacattttggttttcatgggcaaaaccgtaatgacaaaggacaataagaactaatgcaggccagtgcagtggctcacgcctgtaatcccaaccctttgggaggccgaggcaggcagatcacttgaggtcaggagtttgagaccagcccggccaacacggtgaaatcccctctctaccaaaaatacaaaaattagccaggcctgatggtgcatgccggtaatcacagctacttgggaggctgaagcaagagaattgcttgaacccgggaggtggaggttgcagcaagctgagaccatgccattgcactccagcctgggcaaaaagagcaaaacaccatctcaaaaaaaaaaaaaaaaacccaactccaagtgcggtggctcacacctgtaatctcagcactttgggaggctgaggaaggcaggtcacctgaggtcaggagttcaagaccagcctagtcgacacggtgaaaacccatctctactaaaaaatgcaagaagtagtgggtcgtggtggcacaggcctgtagttccagctactgtggaggctgaggcaggagaatcgcttgaacctgggaggcagaggttggagtgagccgaaatcatgccactgtactccagcctgagcaacagagcaagactgtctccaaaaaaaaagaaaaagaaaaagaactaacgcattaaaatacaatttgacattcctagactttaatgtgaccatttcaaatacttcctaaagttacaatgaatacaccagaaaatggagtatgccatttttaagccagtttatagaaacctgtgggatgcaatcaaaaccaatgatcaacttgaccttcacagacctttttaaaatctctaactaaaaaccaaaaaagccaaacatatctttctgctcacttccgtagtcttcacagtataccacccattcataattaaatcttataatctatacctctgtgtcatcacccaaattttagaggtgccttcagatatttcaatataaattgaaagacatttcaaaatcagtttattccacgaaaatgtctatttgtagtggcttaatgattaaacattttgacaattctgtatcattatctggatatgtaattgtttattccttatcaaagcaaagttacatatcacaagagcaactgaggtctgcctcagagaacctgtaagcaggtcatctttagagtgcattgaaaatagaaaatgaagacacccaccttctggaatcttgaaacccacactccaatcacaaggagatgtagagctttccaaggaggcagaaagtttgtctaaaatttcaagataatccacctgactgtcagaaatgtatatgctaggtagcacatgacagaaaattaggctacactcattatttatatagaactcatcaaagccatgcccagatgggcaataggtaacactccaattttgttgcctaagaaacctaacactatctctgtgacactattccaactatagaactctgagatttctaaaaccaaaagtcctaaatatattcaattagggaacaaggtaaaaagtaactccatccccctcaaaaacaaagtttttgttctgctctagatgggctatagcaagagaggcaaccaacctatttacctctcataggacccaaaacttattctgccaaaagaaaacacttgaaaattggagagctaattttaacttaaggtcttctaggactttttgtaaacaagtcctcacccacatctgaaggcaaccccaggcaggtaaaaagacagcaacatactaagacattcagaaaatacaatcttttgcataaaagcccagagaaaactacaagggtgcaagaaaccagtatatttccagcttcaaagagcatttattacattaactaaagaagggttatcgaaatccacactaatagtcaaatcctgttacaacttaaaagggactttccaaagtctttaatggcagtgaaattttgtactgaacatcactgaagtaaatggtccactgggctgggcctttggactttttggttatatggcctctgcagtaaaggtgttttgctataactggatttgacctcttccatgtaagaagatctaaatttttaatgcaaagtattctggaaaataagaaaaaaaatagaaaagtcatttattccaaaatttatagataatccacaccacagtagccaatatatttcaactgtgtcattttaatgttatcttttattgagtaattctctaaagagcttaacggaatggacgctgatttagactttgcaaaactggttactttaacaaataatattcccatgagggcaagctcaagcacttaggatgcataccttgacatatgcaaaaactcaggtttacagctcttcagaaaataggttgacaaccagtctgtgtcacaataactttgttccttttactattctaggatactatgaagtgtatgttaagaatcagaattatacaattaaaaaaatttatactcagtcaactgtttctcagaacatgccatttttctactacctaacaaactatagctcaatgtggcttttaagacaatgaagttttagaatgaaaaatgcaacacggcactttcctttggttaagaaatttaatttagtactaaaggtttaaagcagagtgttctgtatgttttatatctattcctaaatacaaaaattttcttccaggtaactttaaaattaatttgaaacataaagttccttcagaaaatcaagagtcctgattgaacaagggaatcatttatttatcacctataattgacgagaagtctgactggaaagtattttaagattaccaaagtgttttgaaaggatcttcccttagacaatctcatggttaaagaaaattgtccattctcctatttagtcctgtggttctctacattagacaaaggccaccgaatatcacacatggagaacttgatgctcagcttccttgtaaaagcttgtagccttaatcagcttatacacaggataaaaacaagtagacaccggagatgaccttagtggcaaaaagcgacatgagacaatggtacagtaacgaaggtctgtacccaaaagtgtacgttcttatccttctggcacttgaagcgaaatctttagccactcggcctgacacctaaattggataatttatgtcaatttatatggatacaccttcctgggttttcttttgattagagaattgcaaaacaaaaacattaggaaaccattactgtggcagaaagtctaaaaccagatgacataaaccatacctctggttggttgcatcagatcccacatcaagactaaacccaacctgatccccacaatttcttgtgattggtgaggaactataaatgactcccatccaagcttataccagaaaaaaggagcacattttctacaaattatatcatttttaatccattaccacattattttaggggaactacaaaaaaaaaaaatagtggcttaacaagccctgaataacattatatattttctcatctgttttatgaaattttatcaacctacctaacacagttgtagtgagaaagactgacatacttactatgaagcatttagggatcttaggaggaaaagagccaaaaagaaatcaaataaatggctatttttctctcgtttttcattaacataaggtcgtaagtatgacagatttttatgtttgtttgagacggagtctcgctctgtctccaggctggagtacaatggcataatctcagctcattacaacctctgcctcccaggttcaagcgattctcctgcctcagcctcccgagagtagctgggactacaggcgtgcaccaccacgcccagctaatttttgtatttttagtagagacggggtttcaccatgttggccaggatggtctcgatctcctgaccttgtgatccacccgcctgagcctcccaaagtgctgggattacaggtgtgagccaccacgccaagcccagactttttttttaagacggagtctcagttgggtccatgtctcacgcctgtaatcccagcactttgggaagccaaggcgggcggatcatgaggtcaagagatggagaccatcctggccaacatcgtgaaaccctgtctctactaaaaacacaaaaattggctgggcatgatggctcacgcctgtaatcccagcactttgggaggccaaggcaggtggatcacgaggtcaggagttgaagaccagcctggccaggatggtgaatccccatctctaccaaaagtacaaaaattagccaggtgcggtggcaggcacctgtaatcccagctgctcgggaggctgaggcggaagaatcgcttaagcccgggtggcagaggttgcagtgagccaagactgcgccactgcactccagcctgggcaacagactgaaactccatctcaaaaaaaaaaaaaaaaaaaaattagccaggcgtggtggcaggaacctgtaatcccagctactcgggaggctgaggcaggagaactgcctgaacccaggaggcagaggttgctgtgagctgagatcgtgtcatggcgctccagcctgggtgacaaaaacgaaactctgtctcaaagaaaaaataaagacagaggctgggcacggtggctcacacctgtaatcccagcacttttggaggccaaggcaggcggatcacaaggtcaattctggctaacacaatgaaaccctgtctctactaaaattacaaaaaattagccaggcatggtggcaggcgcctgtagtccctgctacctgggaggctgaggcaggagaatagcatgaacccaggaggcggagcttgcagtgagcagagatcacaccactgcactccagcctgggcaacagagcaagactccgtgtcaaaaaaaaaaaaaaaaaaaaaaaggccaggcgcggtggctcacacctgtaatcccaacactttgggaggccacagcaggaggatcatgagaggtcaggagatggagaccattctggctaacacggtgaaactccctctctactaaaaataaaaaaaaaattagccaggcgtgatggcgcgcgcctgtagtcccagctaatcggaggctgaggcaggggaatcacttgaatctgggaggcagtggttgcagtgagccgtgatagaaccactgcaccccagcctgggcgacactgccagactccatgtcaaagaaaaaaaaaaaaatcaaagaatcacttgaacccaggaggcggaggttgcagtgagcccagactgcgccactgcgctccagcctgggctacagagcaagactccgactcacaagaaaagaaaaaaaaaaagtggatctcatcatatctgttacctaagacttttcgtacactgttttctgtactagtctatagcagagttctattgagtcactcatcttacccaaataaagtgtacagatatattcataatttccaaaatccccaccctgttaagtctagagtttaaaaggcctaagataatgaaagccacctttagaagtacttaagtacctgttccatcacttccaaaagggcctctgagcagcaagttgcagaaataattcacagctttgactccttcggcactttagggcaaacaatactttccatggcctagttatcacctaatttaactctttctaccttttaagatcaatggatatataacagttttatcagtaagataaccaaatatcaaaccaaagttaacaaatttaaaacaagacaacctctaatacagaacttgtcaccagattgtcatgatggacttggaggggaaggtatctgaaactatattctgaaatctaagcaaaaaaatccacagttcctccaagagtttgtctcaaaaggcaaagaaccaattttctaaaagcagcaaagaaaagcttcagaagagaattttgtatactttagccacaggaacacaacttaaggtctaaaaccacaaaaaagctcaccaccctcccccaagccccttcttaaaactcactttttgctacgttcttcatggccgttggcactgctcaacttgttctcatcctaagcagggttgatagaagaacatcatgaggacgaagtggtaacatttcaagttgtcaaagggtaaagggaacaggaataagaaaatacaaaacaattttaaaactaattatttacttatagtttaacatggaaggctataaaaaaatttagatgggtatgtgtttaaccactttgttgcttacatttaagtcatcaagatacaaaaataaaaaaattttccatattaacatgttaaattttactttcttatatagtttagatattaaaagttatccagatttacaatgttgaagtggttaaatataatttccataaaacatgaagtcctgttttgagttttattccatgtgctatggtccctttggtcagtaccatggctctatttctgcctaagccccaagtggccatgctagcagccagccactatcgatttcctgtgaccgatgccattcctgagatcttcgcccatttccgttggagggttgggactgtaagagcttgatgccacctctgtcacacatctcgccctgaagcaaacagggattcacactgctttagtaatgttgactcccaagaacccaagaaagtcaattaataatccaccaagtccagcctaaacatttcctacttccatacctgtttacatggaattacatccatgttaaaaaaaactaagacacaagaatcttaacattaaaacagaaagtagctcttcaagagtctaagcattacaaaattacatacactatttaaatctatcaagaattcatccaaattggtaccacatggtcgtgctatacaatccaaaacaaatgtattatttttaaaaggtttagtgaaatgtttattttaaagtttgattacatcagctataggagtaaagtgctaacttacaaagcttacagtttgtgacaccagtgataatgcatgcatactgctattttcaccaccaactggtgaaacaatgaaaagacagtttacttttactgagataccgaaatgagtcaaagactatattagccaatataattcctttgtttttagtgtgaaatactatggtagggcctaattaaaaataaaaacaatatggagaacagtaaaacagtcatcaagtgactctaagcttgtatttactctaagcttgtattaagcttgtattgactctactgcctcttgtattttttttttttaatttctattcagggatccaagaattttagtaattattaactgagcagcagattgccactggactgttttaagatttactatcaccagtcttacatagatacataaattttaaaatctcacccatttcttcttataagactgttagaagatttaacttgccacagactggtcatgctttgttattcttggacccctgctttttcccaaaccactacattcacctttttgctataccaaactggaggtggtaattcttagttgagtcattttacctaggggaccacggtacagcgataagtcactcaattactaccttatgattgacagttcacactggaatcaaaggtgaattcatgggagtagaggtgagatatcgttaggcaagtctacaaagagagatagatgggcatttattcatcacgctgaagtgaaactactgcacaatattattacatcaatagcatatatttacttttgtaagttacacgtaatgcatctctgataagataaatcaagagggctccggggaggttagtttacatttcagcagtagtttcgtgaataatgctaaattaagaaatatataaacctcaccgacatgttttttctcaccttcttgtaaggagcctcaagcattgcttcaatatcaatatcgtctgccattttctctaaacgcctaggaagagaacaagacaatttcttgagtaaacatttctcttacaatgtgaaacaagtttcactcttgttgcctatatcgtctaacattttctctaaacgcctaggaaaagaacaagacgattccgtgagtaaacatttttctttttttttttttttttttttgagacggagtttcgctctagttgcccaggctgaagtgcagtagcgcgatctcggctcactgcaagctccgcctcccaggttccagcgatcctaccacctcacctcccgaatagctgggatcacaggcgcctgccaccacgcccggctaatttttgtatttttggtagagacggggtttcaccatgttgatgaggttggtctcgaactcctaacctcaagtgatccgcctgcctctgcctcccaaactgctgggattacaggcgtgagccaccgcgcccggcctggtaaacgtttttcaaatcgactgaatttttcttctcagccgacacactcgaaaacttaagaaaaacctccaaaagccctacaattaatgactaaagtgacatgcactttaaccaggtttggcttacgtaagtaaatccaaaacgcctcttacacgaaacacacgaaaatgaagacttcaatatccaatatttaaaactctgctgtcaactccaaaaacagaaactgggagacccgaacgagagcgcctctttccgggcaaaaacccgcgctgccattttaggggcaaagagaaactccctccattgggaggggttatgagccaaggcagcgttcaactggcgccatgttgggaggtcgcggccggcccaggcctcgaaggagacaggtcaccattctaccgcggcctctcgggggtccctaccgccccaagaatccagactatacccgactggaaaataagggcgcggtcactgaaacagggccgatttctcgaaaaccaccccccaccccggtcgctaaagacctccaaaagcgcccctcagcccaaaatggagccaaacctcgagaaagctgagataatacgcgggtccgcaacgccccgtacctgttccggccttcgggcgcctgtggtgctcgtgttcgggaagagattgctgctgctgctgctgctgctgccgccgccgccgcttctgttgctactgttaagcccctaggcccaggccgcggaaccgcccagcccgaatatcgggttccaaggacggctaggcccgagagaatctaaaaaaaacaatggaattagagaagcccacgcgggagagcaggacggcggcttcggcagctcaggatccacccctgcgacagcgtcgacaagctccctgaaatggcggccgctgcttccctgtactcacattcaccagcacacatacacacacacaaacacacggggcctcacagagccctcagcacgggctctcgcgagaagctgccccaagctccaaatttgagcggccgaagtatcgcgagacctaagtatggctccggcgaccgtagcccaatctcgcgcaatgattgcgccacagatattcccatcccccattcagtgaggcgcctttcactccccctccgcgtaagcacccaaatctcgcgagacagagcgggtctctagggcaaagacagttggtaggctgcctgtcaatctttcagagagctcttcgctgagtggagctcagcggtcacctccccctcgtggcgcctcctcacggccatctgaagattcctccggcacagccgatcgcccccgctccggcctcccacacagatggctgtcaaggtcgccataaggcaacctagtccttatggcgataggataaaacggccatattcagattatccgctgagggtggagaggaagtggaaaagtgtatcagaaggccagaagaagagatctttaggggtagggggagagggggagataataaaaatagatttccctgtcatttggagccaatggcgcggcctccactgtcgagctttgaaacaaccttggaaatagtggagaaaagcaaaaaaaaggtggaaaaaataaactcttgcttcccttggcatgggatcagttttgtgccccgaatttaatcagctcttgtgtcagggttgctaccgttccttcaaaaatgttccccttcctgaatattactggacgatttggtgaaaaaataagacacccccccaacaaaaaaaaaaaggcccccttccccctgggacctggctcctctcccctgaagtcttctagatgccaggtaattagagtatgaattagccatttgttctttggtcagtactgtgtgaggtttcctcctagatgctgggaaaaaaaactggaaagaagtcttcaaagcaaaaatcttaccctctaatcttaacagtctaatgattgagggcagaaaagattggaaatgagacgccttgattagtgtaactagctgctgcaacactgtgtgaccttggacaagcaaattaacctctcagaggggatctttcatttcctgatttaaaagaggacgtacttagtagctagtctaagctacttgagactgaggaaggcaggtaatgctcagtactgaatttttagaggttagcagggcatgtctgcccaagtggaccctcagtaaattaatgaatgaaggctcagaagggctatagtgaagattaaatgatataatgtctgtaaaacgcctggtaaatatttgatcttcaaaacagctaacttctgtttctgctaaacaaaattatttagagcaaatatagatgttaagtggttttgcctctcaggttaactttacacacaggttaggatttatcttagaggattattaataacagttattttgtagttagaatactcccttaatcctttttctgaaaattcagatcctctttttattttatttctgagacagtctcgctctggaggctgggcgcagtggctcatgcatctaatcccagcactttgggaggccgacgcgggtggaccgcctgaggtcaggagttcaagacctgaccaacatggcgaaaccctgtctctactaaaaataaaaaaaaaactaggtggcaggcgcctgcaattcccagctactcgggaggctgaggcaggagaatcacttgaacctgggaggcagaggttgcagtgagctgagatcatgccattgcactccagcctgggtgacagagatcgagactccatctcaaaaaaaaaagaaagaaaaagaaagaaaagaaaactgtcacaggaaattgaagcataatatgtcagaaataaagcaagctaacctttgctatctcttcctgcccctcggtaattccagtattatgactagtgcaaaatgaaagcatgaagatggcacttggtttttcttgtttgtttaggaacatgacatgacagaatttgaccttaaccgctagacttcttgtttgggaagaggaaggatttaagctctaagtcgcttgatgatttaaggtcccttaaatagttttctgctcaaggaccatcagaggcaatatggcaacttagcagatcatcaagaaaagccgtttggaaaaatcaagtttctgaaacaagtattttttatgtttaaaagaaaatatccccaggcatggcggctcatggcctgttatcccagcactttgagaggccaaggcaggaggattgcttgagtccaggagtttgagaccagcctggacaatatagcaagaccctgtctctacaaaaaatttaaaattagccagacgtggtgatgcatgtctgtagttccaactactcaggaggctgagatgggaggatagcttgggcccaggacttcaagactgcagtcagctagaatcacgtgccacttcaccccagcctgggctgcagagcaagaccctgtctcttaacacaaaagaaaatatcacgaacataagatgcttctcattcactttacaaaacttcactaactctggttcatgaactttctatgtaaattaattcccctttcatcattttgctttcaaaagatggaggaatagagcttgaaatagagccaaaaaggtaatgaatatacttagagaatttggctgaaaactaaatgtattttaccaatgtggatttttaattttttaattattaagggtacattttaaatgtatatgtttatcagatacatgtggtttggttttgttttgttttttgtccccaacaatctacagcaagtagaattgtttcgttttttaattgagacagggtctcacactgtcccacaggctgaagtgcagtggcaacatcatagattactgtaaccttgcattcctgggctcaagcaatcctcccagctcagcctcccaattagctagaaaaacaagtgcacatcaccatgcccagcttaattttttaaaaattttttgggctgggtgtgatgacttactcctataatcccagcactttgggaggccgagataggtggatcacctgagattgagggtttgcaaccaggctgaccaacataaagaaaccccgtctctactaaaaatacaaaattagccaggcgtggtggcgcatgcctgtaatcccatctatttgggaggctggggcaggagaatcacttgaacctgagaggcggaggttgcagtgagccgagatcacgccattgcactccagcctgggcaacaagagcgaaactctttctcaaaaaaaaaatttttttttgtagagatttgggcttcaaatgtgatgttttgataaaggcatattatgtgtaataatcaaatcagagtaattggggtaatccatcacctcaagcatttaacatttcttttctttttttttttttttgagacagagtttcactcttgttgcccaggctggagtgcaatggcgcgttcttggctcacgctctctctctctctctatatatatatatgtgtgtgtgtgtgtgtgtgcatgtgtgtatatatatgtatatatatatatttttttttttttcgagatggagtctcgctctgtcgcccaagttggagtgcaatggcacaatctcagctcactgcaacctccgcctcccaggttcaagcaattctcctgcgtcagcctcccaagtagctgggattacaggagcatgccaccacacccggctaattttttgtatttttggtagagatggggtttcatcatgttacccaggctggtctcgaactcctgacctcaagggaattgcctgcctcggcctcccaaagtgctgggattataggcgtgagccacctcgcccggcctttttctttcttgaaacagtgtcactttgtcacccatgctagagtacagcggcaaaatcacagcttactgcagccttgacctcctgagctcaagagatcctcccatctcagcctcccaagtagctgggactacaagcacatgccaccaggcccaggtaattttagtattttttgtagagttgggtttttgccatgttgtccaggctggtccccaactcctggctcaagggatcctctcctctatgcctccttaagtgctgggattacaggcgtgagccagcatgcctgaccctttttttttccccatatcactaggacaatgggaaacttaagcccatttcatatagatgtaattaattttaacactcatgtgacctttgcctgatttaggcagatgaaattgtatctccccacccaggttccttctgcacttgattatctcatcaatctactgactgattgaattgttttaaatacttgcctgtctattggcacaatgtcaagggtattctagtgacatatccaaaggttttaacttaaatttgtgaatcatgttttttgagacagtcttgcaccatctcccaggctgcttggagtgcagagacttagttatggtttacatggtttactgcaggctcaaactcttggcttagcttcccgaagtgaatcattaggttttttttttttttttttgagatggagtctcgctctgttgcccaggctggagtgctgtagcgcaaccttggctcactgcaacctccgcctcctgggttcaagcgattctcctgcctcagcctcctaagtagctgggattacgggcacctgccaccatgcctggctaatttttttgtagagatggggtttcaccatgttggccaggctgtttttgaattcctgatctcaggtgatccacccaccttggcctccgaaagtgctgggattacaggcatgagccaacatgcccggcctgttgcttgttttttttgagacggatactcactcaatccacccaagctggagtggagtgcagtggcttgatctcagcttacttcagtctccttctcccaggttcaagtgattctcctgccttagcctcccaaagcagcgggaccataggtatgcgccaccactcccggctaatatttgtatttttagtagagacggggtttcaccatgttgaccaggctgatcttgaactcctgacctcaggtgatccgcccactttggcctcccaaagtgctggtattacaggcgtgagccaccacacccagcttggttttttgtttttttgaaatagtctcactctgttgcccacgctgcagtgcagtggcaagatctcagctcacagcaacctccacctcctggattcaagcaattctcatgtctcagcctcctgagtagctgggatttcgaccaagtgggcccaggtaatttttgtattgttagtgcatatggggttttgccatgtcgacccagctggtctcaaactcctggcctcaagtgatcagccctccttggcctcctaaagtgctgggattacaggtgtgagtcgccgtgcctggcagaatgattagtttttaagaagaaatctaggccgggcgtggtggctcaaacctgtaatcccagcactttgggaggccaaggtgggcagatcacctgaggtcaggagtttgagaccagcctgaccaacatgatgaaatcccgtctctactaaaaatacaaaaaattagcagggtgtggtggcgggcgcctgtcatcccagcttctcgggaggctgaggcaggagaatcacttgaacccgggagttggaggttgcagtgagccgagattgcgccattgcactccagctcgggcgacagtgggagactgtctcaaaaaaaaaagaagaaatctttcaagggtacatccctggccacttacttgaggttgataccacattaactttgcttgggatcactgtcaaaaatcctgtcctcaaactcaagataatttcgttagatccgatgtgaactagatagggaaataactgatgctttctgtcagagtttcatctttggtcaaaaaagtaaaatgttttgaactcatcatagttacggcaatgaaaaaaattaaggggcactcataatagcccatgtgtccattccatggccaaaaggattgcccaaaatgctactttagattaaaaataaaagcaaaaagattcaatacacggtaacataaaatgtaatttacggccgggcgcggtggctcacgcctgtaatcccagcactttgggaggccgagatgggcggataacaaggtcaggagatcgagaccatcctggctaacacagtgaaaccttgtctctaccaaaaattcaaaaaaattagccaggcatggtggcgagtgcctgtagtcccagctacttgggaggctgagacaggagaatggcgtgaacccgggacgtggagcttgcaatgagccgaggtcatgccactgcactccagcctgggtgacagagcaagaccctgtctcaaaaaaaaaaaaaatgtaatttacaacactcatttagagcttatcagtgaaatatactgtttactgattcattcagtgtttatttagtacattaggtaggtgaaatactcattaagacaatttgtggccaggtgccgtggctgatgcctgcattcccaggactttggaaggctgaggcaggtggatcatgaggtcaggcgttggagactagcctggccaacatagtgaaaacctatctctactaaaaatacaaaaaattacctgggcgtgctggcgggcacctgtaatcccagctatttaggaggctgaatcccttgaacctgggaggcagaggttgcagtgagccgagatcgcatcactgcactccagtccaggcgatggtgcgagactccaattcaaaaaaacaaaagaaaaaaaaaagaaaatttgcgagcccacagctaatcaaaaggataatcctttttccttcaagggtttccagtttattgagaacacctgaaggaatgtaaaaccatattcaagatactgttttgcattgtactaataagattttgcataaactcaatgctttaaacatcaaaagtcagggtctcggccaggcacggtggctcacacctataatgccaccactttgggaggccaaggcagaggatcacttgaacccaggagtttgagaccaccctggtcatcatagcaagaccctgtctgagaaaaaagatggagtctggcagtgtcgcccagcaggcattgtttggtggcatgatcatagttcattgcagcctcaaacacctgggctcaagagatcatcccacctcaacctaccaagtagctaggactacaggcacacgccactacacctggctattttttttctttcatagagacaggatctctctgtgttgcccagcctggtcttgaattcctggtctgaagcaatcatcccacctcagcctcccaaaatgccgggattataggtgtgagccacctaacctggctaatagtattaataatagcatatttacataacacttcacacattataaacctttttctatataaaaatcccatttattcctctatatcagtttatttcctttttttttttttttttttttttgagccagagttttgctcttttgcccaggctggagggcagtggtgcgatcttcactcactgcaacctcctgggttcaagggattctcctgcctcagcctcccaaatagctgggattacaggtgcatgccaccatgcctggctaatttttgtatttttagtagagacggggtttcaccatgttggccaggctggtctcgaactcctggcctcaggtgatccgcctgcctcggcctctcaaagtgctgggattacaggcgtgagccaccgctcccagccttgtttatttccttgaatgaaatacattgaaatgatcagactataatggaagtgatcacagaatctgcttctgaaagtagctgatttatgtattttatcagagcagttagggagatttttttccaacattttattatgaatattctcaaacagaggttgagagaatagtacagatgcccaccatctattttacgtttaacatttttcaatgtttgctatatcacatattcatctatccctttgtccatccattcatccaacctaatttctgtgtgcttttcaaagcaaattgcagacatcagtatactttatttctaaacacttcagcattgcataatcttaactagagttttttttttaatcttaactagagtttaatagtgttcacaatatttttaaatgacataatatttacatatggcaaaacacacaaatcttaaatgtaccaatagattagttctgacaaatgcttacaaatcgggtaatgttctgttaactttattaagtaaagaaatagcagacacaggcacagagggtcagagaaagcagtatattttgtcccaaaatatcctgatttgacaaccggagaaatggataaaccattgcaaattaggaggcagagtattgtttaaaaacatctgctaacagaagcaaaaataatgcagtcgggcacagcattgcaaaagatttaggaattaagcaaatctagcaatagagaggaagattctgctgacaaggcatcacatgatggagatataccttgaaaatgaaggatggcaaacaaaagaagcatcaactcaatagtggttttgaatgaaaggcatgtgatttcatgatatgaatgaatgaccttgtacaatgaatagcccagaaagacacagcatctctgaaaggatgtagctaataaactcattcttttggggtctgaaaaaaataggttcttaacagtcattttctgtaagaggtctacagacatacatcttgcccaaacatctctaaataaccagctccctagcctacctaggtggcaggaacctgtaatctcagctactcaggaggctgaggtgggaggacttcttgagccccggaattcatgtacagcctgggaaacacagtgagactccatctctaaaataagtgaaataaataaccagatgccatctcaatatataaatgaaacatcagagttggaatatgtgcatcatagacatgaattgtatgctattgttgtaaaggagcaagggatgccgggcgcagtggctcaagcctgtaatcccaacactttgagaggctgaggtggggggatcacgaggtcaggagttcaagaccagcctgaccaacatggtgaaaccccatctctactaaaaatacaaaaattagccaggcgaggttgtgtgcacctgtaatcccagctactcgggaggctgaggcaggagaactgcttgaacccaggaggaggaggttgcagtgggtggagattgcgccactgcactctagtctgggcaacagagtgagactccatctcaaaacaaacaaacaaacacaaaaaaccaacatgggattttggtaagaatgtggagaaattggaacccttatagtttattggtatcaatgtttacatattaatgatatagctgctatagagaacagtttggcagttactcaaaaagttaaacatggagttactctatgacccagcaaatacattcctaggcataacaaaataatttagaacagacatttggctgggcacagtggttcatacctgtaatcccagcactttgggaggctaaggcgggcagatcacttgaaaggagttcgagaccagcctgatcaacaaggtgaaaccctgtctctaccaaaaatacaaaaattagccaggcatggtagcgtctataatcccagctacttcggaggctgaggtgggaggatcacttgaacctaggaggtggaggttgcagtgagccaagatcacaccactgcactccagcctgggagacagagcaagactccatctcaaaacaaaaaaacagacagtcaaataattactcatacacaagtgttcatagccgcactgctcaccatagccaaaaaatgaaaacaacccaaatgcctaccaactgatgaatggataaacaaaatgtagtatattcagacaatggaatattattccgccataaaaacgaaatactgatacatgctataatgtagatgaaccttgaaaacactatgctaagtgaaagaagccagacacaaaaggtcacgtattgcttgaaaccatttatatgaaacatccagagtagataaatccatagagtcagaaatcagattggtaggccgggtgcagtggctcactcctgtaatcccagcactctggggggctgaggtgggcagatcaggaggtcaggagatcaagaccatcctggttaacacggtgaaaccccatctctactaaaaatacaaaaaattagtcgggcgtggtggcaggtgcctataatcctagctactcaggaggctgaggtaggagaatctcttgaacccgggaggcagaggttgcagtgagccgacatagcaccactgcactccagcctgggtgacagagagagactccgtctcaaaaaaaaaaaaaagaaaccagattggtctttgccaggagctggagggaaggaggaatgtggggtgactacttaatggctataaggtttcctgttggggtaataagaatttaccagaactagatccacctagttaagagttccaggtagtggtagcgatagatgctctggatcgagttgtaaagcccaaaatgaaaagagtcaagagattccttgagaagagagaaccaaaactcaatgaaaatattaaaaatgcaatgctgattaaagggggaaatgcaaacgcaacagtgacacaagtacttaaagatgtgtgtgcactgaaaaaaccatacggtgtactgtataaaaagaaaaatgttacaagaccttttgaggatcagacatcactggaattactttcaaagaagtcagattgttctttattcatgtttggctcctataataagaagcggccaaataatctagtaataggtcatatgtatgactaccatgtgctggatatgattgaattaggtattgagaattttgtctctctaaaagacattaagaacagtaaatgtcctgagggaacaaaacccatgctaatatttgctggtgatgatttcaatgtaacagaagattacagaagactaaaaagtcttcttactgatttcttcagaggccccacagtatcaaatatctgcctggctggattagaatatgttctgcacttcactgcactgaatgggaagatttactttcgaagatataagttgctgttgaagaaatctggttgcagaacaccacggattgaattggaagagataggaccctcattgaatctggttctgaggaggacacacctggcatccgatgacctttatacattatctatgaaaatgccaaaagctctcaagccaaagaagaagaaaaatatctccaatgatacttttggtacaacttatggaaggattcatatgtagaacgaagataagcaaactacaaaccaggaaaatgaaggggttgaagaagtgacctgcagaaaggataacagaagaccaggagaaaaagtcaaaaagaatttaaaagaaattatggaaaaaaaaaaaaagaatttaccagaactagacattggagaaggttgcacaacattgtggatgtaaatgccaagaattgaacactttaatatgattaatggttaattttattttatgtgaatcttatctcaataaaaagagaatagactgggtgcagtggttcatgcctgtaatcccaatactttgggaggccaagggggaggatggcttgaaattaggagttctcaaggccagcctgagcaacagagaggaaccctatctttttttacttgttgttgttgttgtggttttgagacaagggtcttgctctgtcacccaggctagattgcagtggcctggtatgattgatctcactgcaactctgcctcctgggtataagcaatcctcccaggtgtggctgggatgacaggtgtatgccaccatgcccagctaatcttcatgtcttttttggtagagatagggtttttctgtgttgccaaggctggtttcaaactcttgggctcaaacaatctgcctaccttggctgcctaaagtgctaggattacaggggtaagctacctctcctggccttgaccctatcttaaaacaaaaacaaaaacaaaaacaaaaaaacctagcagggcatggtgacatgcacctgtagtcccagctacatgggaggacgaagtgggaggattgctggaacccaaaagtttgaggtggcagtcagctatgatggcactgctgcatttcaccctgggcagcagattaagaccctgtctcctaaggaaaaaaaaaaaagaaagatattttaaaaaaaggaaagaaacaagggaccttctcagaacctctagaatcaagagcgagatgctggatgatcaatgaaatgaaaaccctcagccaggcgcaatagctcacgcctgtcatccaaacactttgggaggcagaggtgggcagatcatgaggtcaggagtttgagaccagcctggccagtatggtgaaaccccgtctctactaaaaatacaaaaattaggtgtggtggcgcgtgcctgtagtcccagctactcgggaggctgagacaggagaatcccttgaaccctggaggcagaggttgcagtgagccaagatcgtgccactgtactccagcctgagtgacagagcaagactgcatctcaaagaaaaaaaaaaaaacccacacacaaaaaaaccaaaagagactcaaatccctgctttcttcttcttcttctttttttttttttttgagacagagtcttgctctgtcgcccaggctggagtacagtggcgcgatctcggctcactgcaacccccgcctcctgggctcaagccgttcttctgcctcagcagcccgagtagctaggattacaggcacgagtcaccacgtccagctaattgttttctatttttagtagagacgggtttcaccatgttggccaggctggtcttgaactcctgacctcaagtgatccgcccacctcagcctcccaaagtgctgggattacaggcatgagccactgtgcccacccaaatccctgctttcaaatacccacctcttctcatgtcatggctacattctgcacttgcagaatattgaagtaattccatatatatatatatatatatatatatatatatatatatacacacacatatatatgtatatacatatacatgaatatacatatacatgaatatatgtatatacatatacatgaatatacatatacatgaatatatgtatatttacgcatatatattatatatatttactacatatgtattttatatatatacatatatatatattttttaattgagacggagtctcaatctgtcgcccaggctggagtgcagtggtgcaatctgggctcactgcaacctctgcctcctgggttcaagcaattctctgcttcagcctcctgagtagctgagattacaagcccccaccaccacgcccagctaatttttttgtatttttagtagaaatgggtttcaccatcttggccaggctggtcttcaacgcctgaccttgtgatccacccgccttggcctcccaaagtgctgggattacaggcatgagcccccatgcccagccatatattctatatgtatatgtgtggcagtctactatgtgccagtcactaaactaggcactggtaaaacaaacaatggagtgcaaaaaacagtcatggcccctgccctcctggagctaacaaaccttcttggaagaggcaggcattgatcaaaagactatatgaatagggctaagcacagtggctcaggcctgtaatcccaacactttggaaggatgagccaggtggatcacctgaggtcaggagttcaagaccagcctggccaacatggcaaaaccctgtctccactaaaaatacaaaaaaattagctgagcatggtgacacatatctatattcccagctactcaggaagctgaggaaggagaatcccttgaatccaggtggtggaggttgcagtgagctgagatcatgccactgcactccagcctcgtagacagagcgagactcaaaaaaaaaagaaaaaaaaagactatataaataaatgaagatgcacaactgtgacaattgctataagagacatttatggtgctataagagcaaataagaggaagatttgggccaagctcggtggctcacaccggtaatcccagcaccttgggaggctgagatgggctgatctcaaaaaaaaaaaaaaaaaaacaaaaaaaaaaaagtaagatttgaggagcagcgtataacaggtaaagaatattcctggcaaataatagactgtgcaatagccttgcagcagaatgaagcatggtgtctttaaggactacaggaagaccatgtggctatagcaaagatgcttaggaagagcccaaccatgtaataccttctaagccagggaaggtgagtctggtttgttgttgttgtggttgtttagatggagtcttgctctgtcaccctggctggagtgcagtggttagatctcgactcactgcaacctttgccccccgggttcaagcgattcttttgcctcagcccctccagtagctgggattacaggtacacaccaccacacccggctaatttttgtatttttagtagaaacgggtttttactatgttggtcaggctggtctcgaactcctgacctcgtgatccccccgcctcagcctcccaaagtgttgggattacaggcgtaagccacacgcctggcctaatttttatttttatagacatggggcctcactttgttgcccagcctgatcttgaactcgtgggcacaagcaatcctcccaccttggcctcccaaagtgctgattacagatatgaacctccatgcccagcagttttttcaacacttacagaactagtctcattgcctcttcttcagagataccagcacctggctgcccaatgccccatactcacaagtctggtttctaccccttggggttcttcctctgagttcagagacacgagcacctgtcaatcaatacctcctcctcagaggtctgagtgtcggctgtgtttggccactccccctctaaatttctatgttttaataactccaacctcttccttttgttccctcagccctaggggtggtagctgttcctacagttactaccaccatgaaactttaggtttcgccttttacttcttcagttacttagttaacaatccactaagttacactgtctctgtccaaatgccatgtgatttctacctccttacaggaccttgactaatatataaggattgttatttatccttcaaggtccagttcaagtgctgccttctaatgtgtcttttccattatcctcagttaaaattatccatccagttaattcataatgtctttcttgaaaagccaataggcgtttgtttttataattatatgcccagtcacactcatatgcctactcacatctctttgttgtcctacagttatactgaaacttctttactcaaattaactctgatccaaaaaaattgcctaccaattataatagagaagagtaggtatagagcaagaaggaacaaacatgggttctaatccattcaattacataatgtaattctgcacagtttacttaaactctcagttaaatttgtttctctagcctcacagacggctctgaggattaagtagaataaatgtggaaaggattaagtaagataatatgtgtgaagcatttaccacagtgcctgtctaatgccccaagtattcaataaatataaactattggccgggcgcggtggctcatgcctgtaatcccagcattttgggaggccaaggcgggtggatcacaaagtcaggcattccagaacagcctggccaacatggtgaaacccgtctctactaaaaatacaaaaattagccgggcatggaagcaggcacctgtaatctcagctactcgggaggctgaggcaggagaattgcttgaacttgggaggaggaagttgcagtgagccaagatcgttgccactgcactccagcctgggcgacagagcaagactccatctcaaaacaaaacaaaacaaaacaaaaagagttatgctgagtcttctctgcctatgttctataaatggaacaataaagcctggatgacagcacatctgtttacaacatagtttattgaatatttcaagcccactgttgagacgtactactcagaaaaaaaaaaaaaaaaaaagattcctttcaaactattactgctcattgacaatgcacctggtcacccaaaagctctcagggagatatacaaggagatatacaagatatacatgcctgctaaaacaacattcattctgcagtccatgaatgaaggaataatttggacttccatgtctttatctttatttttaaaaaatgtttatttttatttctatttatttatttatttatttatttatttttgagacagaatctcacactgtcgcccaggctagagttcagtggctcgatctcgctcactgcaacctccgcctcctgggttcaagcgattctcctgtcttggcctcctgagtagctgggattacaggcgctcaccactacgcccagctgatttttgtatttctttagtagagatggaaattcactgtgttggtcaggctgatctcgaactcctgtcttcaagtgatctgcctacctcagcctcaataaagtgctgggattacaggcgtgagtcactatacctggcctttattttttattcctcagcgatttttatatagagatcaggtcccactatgttgtttaggctggtctggaacacctgggctcaagcaattctcctgctttagcctcccaaaatgtaagccaccatgccaagcctgactttcaaatcttattgtttaagaaatacctggccgggatacctggccggggccagacctggtggatcacgcctgtaatcccagcactttgggaggcagaggcaggtgaatcacctgagatcaggagttcaagaccaggctggccaacatggtaaaacaacgtctctactaaaaatacaaaaattagctgggcatggtggtgggcacctgtaatcctagctactcagtaggctgaggcagaagaattgtttgcacttgggagaaggaggttgcagtgagccaagatcgtgccattgcactccagcctgggcgacaagagcaaaattccgtcaaaaaaaaaaaaaaaagaaggaaggaagaaagatagatagatagatctggctgggtgtggtgcctcacacctgtaatcccagcactttgagaggctgaggtgggtggatcacctgaggtcaggagtttgagatcaacctggccaatatggtgaaacctcgtctctactaaaaacagaaaaataggggctgggcggggtggctcacgcttgtaatcccagcgctttggaaggccaaggcaggcagatcacaagttcaggagtccgagaccagcctgtgcaacatggtgaaaccccttctctactaagaataatttaaaaaaaaatagccaggcgtggtggcgcatgcctgtaatcccagctactcaggagactgaggcaggagaatcacttgaacccagggggcggaggttgcagtgagccgaggtcacaccactgcactccagcctgggcaacaagagtgaaactctgtctcaaaacaacaacaacaaaaagacactctacattttcttatatttatttagttccttacttagttattttgagacagtctggctctgtcacccagtggaatgcagtggcacaatcatggctcactgtaacctcaaactcctggactcaagcaattctctcacctcagcttcccaagtagttgggactacaggcacttgccatcacacctggctacttcataaagtttttttgtttgttttttgaggcagagtcttgttctgttgctcaagctggagtgtactggcatgatcttggctcactgcaaactctggatcctgggttcaagtgattctcctgctttagcctcccgagtagctgggattacaggtgtgcgccaccatgcccagctgattttttttgtattcttttagtagagatggggtttcaccatgttggccaggctggtctcgaacccctgaccacctgccttagcctcccaaagtgctggaattacaggcatgaaacactgtgcccagcccaacaatatattttatacaatggaataaatataaggtccttattattttgttttatgttactgctgcatagtattccttgtgtggacatattataatttgcttaatcagtcccctattgatggccatgtgggtgacttccaattttctgcctataagctcagcactttgggaagccaaggctagaggatcacttgagcccaggaattcaagaccagcctgtgcaacatggtgagaccctgtctctacaaaaaaatttaaaaggccaggtgtggtggctcatgcctataatcccagcactttgggaggctgaggcagacagatcactagagcccagcagttcaagaccagcctgggcaacatggtgaaactctctgtctacaaaaataatacaaaacttagccggatgaggtggctcacacctgtagtcccagctacttgggaggcttagatgggaggatctcttgaacccaggagatggaggttgcagtgagccaatatcacaccacagcactccagtctgagcaacaaagcaaggctccatctcaaaaaatacatcaataaataaaatttttaaataataaaaataatttaaaaattaaagttagccaggcataatggcatgcatctgtagttccagccacttgggaggctgaggtgggaggatcacttggtcaggaaaggtcgaggctgcagtgagttatgatcgtgccactgcactccagccagggctaaaaagccagactttgtctcttaaataaatatataaaataaaaagagaagttttggaaattatcgtgatgatcttgtgtgggaaatattctgaacacacaaaaaggacaagacattaaagaaaatattataaattcaagtacataaaatatttatattttattcatggatatacatatacacatgggtagtctcagaagcgttagggaattgagacagaatggaagctaaagaagagtaacaggtcaggtgtggtggctcacacctgtaattccagcatgttggggggccaaggccagcgaatcaggaggtcaggagatctagaccatcctgggctaacgcagtgaaaccccatctctactaaaaatacaaaaaattaggccgggcgcagtggctcacgcctgtaatcccagcactttgggaggccgaggcaggcagatcatgaggtcaagagatctagaccatcctggccgatatggtgaaaccctgtgcctatacaaaaattagctgtgcattgtggcgcttgcctgtagtcccagctactcaggaggctgagacagaagggaggcggaggttgcagtgagccaagattacgccactgcactccagcctggtgaaagagcgagactccgtttaaaaaaaaaaaaaaatttagccaggcgtggtggcacgtgcctgtattcccagctaccggggaggctgaggcaggacgccagtgcactccagcctgggcaacagagcaagactctgtctcaaagaaaaaaagaaaaaagaagaagaataacaaagaggagccattcatttactttgttttcaatgtttatatgtttataaacaatgttgcaataaataatttccctactgatagtcaatcacaacttttccattgttataaaccatgcttcaataaacatccttttatattcaaaaaacaagacaaaaaccaaaaagaaaggaaaaagtggggctgtgtctggcttagtgggaattgggtgccaagaaacaaaagcatgattgagtgttatctgtgtaattatgtgcatttgaggttaaaaaaaaggaggacagtagaaatgttgataattgctgggcgcgatgtaatcccagcactttgggaggccaaggcgggtggatcaccagaggtccggagtttgagaccagcttggccaacatggagaagccctgtctctagtaaaaatataaaattagctgggcatggtggcgcatacctataatcccagctatttgggattctcttgggattaaggagaatcgctcaaactcgggagttggaggttgcggtgagctgagatcacgccactgcactccagcctaggcaacaagagcaaaactctatctccaaaaaaaaaaaaaaagaaggaaaagaaatgttgataattaatgctctgccacccggacctctgcgaatcccttcttgtctgcttactgactcaccaagaccctaaggctctctctcccttcactgtcaccctacacttacagatttgaaatcttgcttccttcatttcaccctccccagcctagtgcatacttcccttgggcctaaaaaggtatctgaagtccaatctgaattccaaattccacactctaaatagcaccactaaagaaagtcactggaggaacaattatggaaaaacaggcactgacaggtactctcacgccttgttccattttccctgctttccttgactatgtcattgtcctatcccctcgccccaacccacgactacttcacaagcaccaaactcttttcagcctttattctttttttttttttttttttttttggggacagagtcttgccctgtcgctcaggctggagtgcaatggcgacatctcagctcactgcaacctccgcctcccgggttcaagcagaggctcctgccttagcctcccgagtagctgggattacaggcgcgcaccaccaccaccacacccggctaattttttgtaactttagtagagatgcggtttcaccatgttggccaagctggtctggaactcctgtccttgtgatccacctgccttcgcctcccaaagtgctgggattagagccatgagccactgcgtccagccttcaccctttattattttcagagttatttatcctacaagctacatcattgcccctcctcctcttccctatctcctttcattttcaggggagcctatttattagaggaagtaaactgaaggcagaaatcttcaaatacctggctaaaataaaaattattttttttagccgggtgcggtggctcacacctgtaatcccagcactttgggatgctgaggcaggcagatcacctgaggtcaggagtccagactagcctggccaacatggtgaaaccccacctctactaaaaatacaaaaattagccaggtgtggtagtgcatgcttgtaatcccagttactccggaggctgaggcaggagaatcgcatgagcccaggagacggaggttgcagtgagccaagactgcaccattgcactccagcctgggcaacagagtaagaatccgtctcaaaaataaataaattaattaattaaaaaaaataaaattgtatttaaaaaactccaaaacccttctttttttttttttttttttttttttttttttttttttttttgggatggagtctctcactctgtcgccaggctggagtgcagtggcatgatctcagctcactgcaacctccacctcctgggttcaagcgtttctcctgcctcagcctcccgagagtagctgagactacagtcacacaccaccacgcccagctaatttttgtatttttagtagagacggggtttcaccatgttggccaggatggtcttgatctcttgacattgtgatccgcccgcctcggcctcccaaagtgctgggattacaggcgtgagccaccatgcccagccaacatttcttaaaaaaaataaaagccacaatctgggtgcagtggctcatgcctgtaattccagcactttgggaggccgaggcagttggatcacctgaggtcaggagttcaagaccagcctgaccagcgtagaaaaaccctatctctactaaaaatacaaaaccagcctggcatggtggcacatgcctgtaatcccagctactctggaggctgaggcaggggaatcgccttgggaggtggaagttgtggtgagccaaggtcataccattgcactccagcctgggcaacaagagagaaactatgtctcaaaaaaataaaataaaataaaataaaataattaaaaaattagccaggtgttgtagcgggtgcctataatcccagctactttggaggctgaggcaggagaatcacttgaaccagggacgcgcagtttgcagtgagctgaggtcatgccgttgcactccagtttgggcaaaaagagcaaaatttaatctcaaaaaaaaatatcctttcatcatgtcctttcacagattagctcttatctgccctttttttttttttttttttttttttgagacagagtctcactctgtcgcccaggctggggtgcagtgacatgatctccgctcactgcctcagttcctgcctcagcctcctgagtacctgggattacaggcatgcaccaccacaccaggctaatatttgtacttttagtagacacacggtttcaccatgttagccaggctggtctcaaactcctgacatcatgattcgtctacctcagtctcccaaaatgctgggattacaggcgtgagccactatgcctggccacgcccagctaatttttgtattttagtagatatatggtttcaccatgttggcccagctggtctcaagctcctgacctcaatgatccacccaccttggcctcccaaagtgctgggattacaggtgtcagccaccctgccagcctcttatctgccattctaatggaatctgctcaactctctaccccacccatgcaactcactttcatacagaattcctgtatgcatgaaaacatgcccagccaggcacggtggctcattgctgtaattccagctctttgttaggctgaggccgacagatggcttgaaaccagcctggccaacatggtgaaaccctgactctactaaaaatatgaaaattagccaggtgtggtggtgcatacctgtaatcccagctactcaagaggctgaggcatgagaattgcttgaaccctggaggcagaggttgtggcaagccgagatgtcaccactgtactccagcctgggtgacagagtgagacaatgtcttaaaaaaataaaaaaattagggctgggtgcagtggctcatgctttaaatcccagtgctttgggaggctgaggccggcagatcatgaggtcaggagtttgagactagtctggccaacatgatgaaacgccatctctactaaaaatacaaaaaaaattagctgggcatggtggcaggcacctgcaatcccagttactcaggacgctgaggaaaaagaattgcttgaacctgggaggcagaggttgctgtgagctgatacctcgccactgcactccagcctgggcaacagagtgagactctgtctcaagaataaaataaaataaaataaaataaaataaaataaaataaaataaataaataaaaaaacaaaatgcttggctggatgtggtggttcacacctgtaatcccagcactttgggaggccaaggcaggagaattgcttgagcccaggagtctgagatcagtctgggccacatagcgagaccccgtctctatgttaaaaaaaaaaaataggaaaaaagaaaaaaaagcatgcccctgtctatattttattttcaccgagtaatgtgctctatttctggaaatactttcatccttccttcctctggctctccactgatgcatctccaaagcaactccaatcaattcaacaaatagttgttaaacaaccagcacattctaggcaggatgctaggagctggggggatcgagataaacaagaagcagtcctgttcccagagaagttcacaatctgatggtaaaagcaaatacaattatgtaagaaaataaatcaaattaggccaggtgtaatggctcacgcctgtaatcccagcgctttgggaggctgaggtgggcagatcatgaggtcaggagatcgagatcatcctggctaaaatacaaaatactaaaaatacaaaaattagcccggcatagtggtggacacctgtaatcccagttacttgggaggctgcgcaggaggataacgaggtcaggagatcaagaccatcttggctacgtaggagaatcgatagaacctggaaggcagaggttgcagtgaactgagattgctccactgcactccagcctgggtgagaagaacaaaactccatctcaaaaaaaaaaagaaaaaaaaatttcggctgggcgcagtggctcatgtctgtaattccagcactttgggaggctgaggcaggaggatcatgaggtcaggagatcgagaccatcttggctaacatggtgaaaccccgtctctactaaaaatacaaaaattagctgggcatggtggtgggcgcctgtactcccagctacttgggaggctgaggcaggagaatggcgtgaacctgggaggcggagcttgcagtgagccaagatcaccccactgcactccagcctgggcgacagagtgagactctgtctctaaaaaaaacaagttttgtttaatgaaaaaagtaaggtgaacaacaacatgaataaatgttccttttgtgttaaaggatcaatataagaactgtatcaaagtttgcttatatatatgtaaagaaatactgatggtgtgcacctgtagtcccagctacttgggaggctgaggtgggaggactgcttgagcccaggagtttgaagctgcagtaagctgtgatcgtggcgctgcactccagcctgggcaacagagcaagatcctgacacaaacgattcattaaaaaagtaagtgtcatgtttaccaattggaactggaccaatgagggacaagaatttcagggagactttgtattgtacaacgtttatgtaatttccagtatttgaaccatgtgacaacattaactgtttaaaattaaattacaagaagtttggagactgaagtggattacctggatattccaagactgtttgtttaatttacctctttataacctccattctcttagtccctgaggcgaaaatcctccccgtttccctttatctctaggctcgtaagaattttaacccacaagaaatatttattaggtatgtttaaattacaggtaacagtgactggagtgcaatggtgtgatcccagctcactgcaacttctgccttctgggttcaagcgattctgccgcctcagcctcccgagtcgctgggattacaggatgcgccacgacgcctggcaaatttttgtattttagtagagatggggtttcaccgtgttggccaggctggtctccaactcctgccctcaggtgatgtgccggccttggccgcccaaagtgctgagattacaggagtgagccaccaagcctggccccccctccttttttttttttttttgagacagagtctggctctgtcgcccaggctagagtgcagtggcatgatgatcttggttcactgcaacctctgcctcccgggttcaagcaattctcctgcctcagcctccccagtagctgggattacaggcatgtaccaccacgcccagctaatttttgtattttagtagagatggggtttcaccattttggccaggctggtctcgaactcctgacttcaagtgattcgcctgccttggcctctcagagtgttaggattacaggcgtgagcttctgtgcctggccttatcagcctttttagtgactaggacaagaatacaaaatgctttcctttccttccgactgctccctccctccttgtaatcatgcaaaatgcaggaagtaatttggaattcctagttaattctcctccccctcacttggagagcagtgaaggcctggggagttcgggaactttccgtggagcccagactggagagacgtccggccagggccaagacaacctgcttcccttgggcctctggtgccttgttgaggtcttggacctttcagatgctactgtgactgtggtttccggcttcctgagttctcacactcagcttggtgctgcagagatcacaccccagttcctgcttttggggactgacatgctcaagtttggtgatactcagtacatggggtctgtgagatctagagggcttacttttctgttttagtttccctcttttcccttaacagactcactgtaagtgctttagggttgcataaggatagagtatagaggtttgctgggtagacattgagaaagatcagtttcctaattgaatattttatctcatgttggatctttaattctgcttctctttagctaggaatattttgaatatgctgaatctagtaaaaaagaaattagaaatgaagttgtatagaactttgtagttcagtacattttctcacatattattgaacttaaacgtgacaattctgcgttggtagatatatattatcccattgagtaaaaaaagtgaatattgaagaaaagcaatgcctacagagagtgacaactcttccatgcaggtagatgctttttgtgctatcctatactttgtatggatgcacacagggtttcattgtggagctctcagcttatgggctgggactacagttttgaaatacagtattagtaagatgctggggaggatcttaaggcagaaggtagatgttacttctggtctaaagtcagtggactttagaccaaaatcttgtaaactggagctctctggctagcattccattaatattcagttcagaagaagctggtaagtcaaatttctgcaagtttttacatcagaaagagcttagctcacaaggtacttttttctcatctgtattcagttatttttccctgatcagtgtcagtctccttccaaccctcacttcccatcttggggagtacccttaggggcaggtcattcctctcttctttccctggcaggctggactcatccatgtgacctgagattggccaatcgacagtggctgctggccaagaccttgcctcttgagtgagtgactcaaagacaaagggatactaagattgaatcacagcagtggtgcgcagtgttgctgggggcagcagctgttgttgctctttcttggtggagctgtccttgtgcctgtttgttttccaagcctgcactcctgttgtagctcaggggcccttgtaacatatttctcttttgcttgccatgattacttcaccagtctgtgagctcctcgagagcagggcctaagtctcattgtgctctgagtgtttggtgcccatcttgaatttgactctcggtaaatgcaggttgaataagtaaagaaacatgctatatttatacggggctacagagtctggagttcttggcattattgtggttggggggcaaaaagttctttgtgtgctaccatagccactgacatctgagcaatttcatattaataaacataaacccagaggatcttgggaaggcccttcctatatgtgagcacttacttgactgagtggcactgattctcaaattgctgattttttaaaaagtatgaaatgtatcatgaatttgcatgcttatccttatgcaggggtcatgtgaatcttttctgtattgttacaattttattttattttattattattttttgagatggaatcttgctctatcacccaggctagagtgcagtggtgctatctcggctcactgcaacctctgcctccagggttcaagtcattctcctgcctcagcctctcaagtagctgggactacaggcatgcaccaccacacctggctaatttttgcatttttagtagagagagggtttcaccatgttggccaggctggtctcgaactcctcacctcaggtaatctgcccgtcttggcctcccaaagtgctgggattacatgcgtgagccaccgcgcccagccatgttacaattttaatagaatacatgtactgcccaagcaagtgtagctgaagcttttgtccctggttccacagtgtctctacctaagggctgctctttgccctgactacctcaactgaggcaataccctccttagtttccagccctggtttaaaaagcacccctcaggctggatttgctggctgaggcctgtaattccagcatttctggaggctgaggcaggaggatcacttgagccaaggagtttgagaccagcctggtcaacaaagtgagaccctgtctctaaaaaaaaaaaaaaaaaaactcggccgggcacggtggctcacgcttgtaatcgcagtattttaggaggccgaggcgcgcggatcatgaggtcaggagttcaagaccagcctggccaagatggtgaaaacccgtctctactaaaaaaaatataaaaaattagctgggcgtggcggcgtgcgcctgtaatcccagctacttgggaggctgaggcaaagaattgcttgaacccgggaggcagaggttgcagtgagccaagatcgcaccactgcactcccgtctgggctacagagcgagactctatctcaaaaaaaaaaaaaaaaagtggccaagtacggtgttaattccagcactctgggaggctgaggtgggtggactgcttgagcccaggaattcaagaccagcctgggcaacatcgtgaaactgcgtctctacaaaaaaatgcaaaaattagccaggtgcacacctgtggttccagctatctgggagactgaggtgggagaattgcttgggcctaggaggtggaggttatgaggagccgagactgcgccactgcactccagcctgggtgacacagtgagaccgtgtctcaaaaaaaaaaaaaaattagctaggcatggtggcatgggcctgcagtcccagctactcagaaggttgagctgggaccacaggtgcgcacgttcacgcctggctaattgttgtatttcttggagagacgggggtctagctatgttgcccaggctggtctcgaactcctgagctcaagtgatctacccacctcagcctctcatagtgttgggattacaggcgtgagccactgctcctggtctcatattcttttggggtggcttcaactccgaccttcgtccccagagaaaatacagctccttatccttagcagcaattggaaacctttctaggagttaatgataaagtgggggagaaatgagtgcaaaggctctgagatgagaagaacctggattgttagcggagttgaaggacactgagaatgtgggggagctggattcgtgaggataagaaagcagcaggtcaggtccagactttgaagagcctggtagatagtctaggtgaagagttagatcttaatccggagtagggagggaaacgagctttgagcaggggatggcgttttgaaaagacctctctgccggtgtacgaagaatggattagaacggcgaagagtaatagggtggaaaccatcttcatcttggagagagatggtggtcgcttcgatggagaaatgggaagctttgagacgcatttaggtggcaaaattaacgggtgatggatagcgtccattccccggcttcggtgatctcagtgattacgagtgagtggggacttcgtgttcctgctagggcgcgggcctgtttcccgcgcgtcagggtagtgggcgtggcctgcgcaggccgttgccacagtgatcgggcagacggggcagggggcggggcagctgggaccttacgtcactcggtggtggcgatgatgcgtgtgtgtggggggcggggcatacgctgggcgcgtcccgggggtcacgtggtgcagagcacgcagagtccttctgtcggttggtcctggagcggcgcagccggagtggggccgtgaggtgagctcgcggccaggcgaagccggccggccgggccgggttgggccgggcccgcgctgcgcgcgcgccgtgcgggcggggacggcgacggacgccaccgctgcttcggtcccctgcccggccccgctccccgcctggccccgctcgcccagcctggagggaggccctgggactgctgctgagagcgtggcgggcgtgcgagcggtgcccaatccccggggctacccgcaagagtggcggcggctgccgccaatcagcgccgcccgagggggctgggccgtggggtgcgggcccggggcgcggagcgggccgtgttgggggtgcgggtaagccctagggcccgagcctgagctgtgtgggcacctagagcctcatcagcagcctctgctattgccttgcgctttgggaatatgttttttaaaattggctttttttatcctattctggggagcacattcctttctcaagaccccaaatatgggagtgtcccttttctctatagttttgaaaactgggcggcacaccccctttcttaagctctagctctggaattttatctaaatttctaaaagccctcccccccccaaatttagggcgtaccctcttccgtcagcccccaaagtgggagcacattccttttttcgggcctccaatttgattctgcatttccgttccaatttagaggttcaccctgttatcgggtcctcagatctggggtccattagctaaagttttgggatactttcttgtatcccctctactccaaggaagaattccccttttccaggtcccaaatctgacagcatgccttctggaatttcttacatttaggggccacttcctttcctcagcccttcaaacctgaggttgggccgaaaacaatgtccaaattttgaagtttatgggtacttatttccagtttcacaaataagggaattcactgccttctcccgagactgtattattggggttacacacttttcacgtgttccccaaatcaaactaccttatttcctgaaggagactcattttcatatctgggagtatatttgtttcttgtgccccccaaatgtacgaggtgaaccccttttagttatacaactctcagagtgcagccactttccagatgcttcttaaatttggggggcacacctttttgtgagtcctctcatttccaggtggcgagtggtctgtggttttgagcatgccttcctaccctgtttagcttttctgtcatccaagacattttcattcctcagtttccttccctttttggagccacactccccttgaggtgctttccccagtctggtcagtgcacccatttcctcttcctctggcgagtgcgtatctttgttcagcacggcacttttctctgtgcttctgcgggcttttcttctgagcacacttcccagagtcacacctcctgaattctcctctcctcccagggaaggattcctctcctaaagggctaccagcacattgtttttgataggcctatcttttatctttccgctagcaggatctcttctctcttggcttgcccaatccccaaacatttttctggtttctgtctttctttggaattgttctgtttacctagtggctataaagattttccttgtgctggaggtggcctcaagtctaggactgcctgggcccccagcgctggattcaaagtggaaaccatttctttggttaatcacaggactctgaatcctcctggtggtttacttctagaagacctaagattctgtttaggtgcatactgttttctcctttgctttatctccttgtgctggaaaacaaaaacaaacaaaactctcagatttttccagcactgcttctagcccataaacttcttccctatattggctttcttactatcttttatgaagaaaagatgtcgtttggaggaatcccttggatactctttttgttcttgtccctggggtgtcggtggggaaatggatatttttctctcccaatcatcctcttgtcaatcttctttttttttttttgagacagagtctcgctctgtcgcccaggctggagtgcagtggcgcgatctcggctcagtgcaagctccgcctcccgggttcacgacattctcctgcctcagcctcccgagcagctgggactacaggcacccaccacaccgcgcccgtctaatttttttgtttttagtagagacggggtttcactgtggtctcgatctcctgacctcgtgatccacccgcctccgcctcccaaagtgctgggattacaggcgtgagccaccaagcccggccaacctcttgtcaatctttacccccaatcctcacattaaaatctgcaaatatctgggacctcctatctcttaagagcctcaatagttctttcttttgtgtttccttctgcctttacagatcttattcagggcttctcagcctgaacccccaaccagattaatttctccacagctggaattccaagtgcttggggataatgatacctctgacctttcttccttttgggaagtacttgagtgtgcagctgcatgaggcctcagcaggagagagattttaggtccaagaagctataccagtaggacaaggcaggaaaatactacactttcaggatcaagcccctctgactctcatttggaaactggatgtttgctaagcacctgcttcttaaggatgccgagggatttaatgatactcccagaaacctggagagattaatggggcctatggagaagtgctctgaactcagtgttgggacttgaataaaattaaccattgtcatgttttcagaacaactaagctgttttatatttcatgtgcatgaaagccctagaactaagttgtgttatttccagaaatgaaatagatcccacagttagatgatgtggccattaggaagtaccaaatttataaaaatcactggaggtctgtctgagcagtacctaataaaatatagtatactgaaagtgaacagatactttgtctctttctttggctgcttgatactttatctgtgtactgccgtacagtgcacccttaaagtattctacaccagtgcttctcaaacttgaatgtgcatgtaagtcacccaggggtcttgttgaaatgctgattctgatttggtagatctaggatgggacctgaatgcatttctgatttgcaggtgatgctgatgttactgaactacacttttagtagtgaggtttcatacacgaagacaaagtttctctgtgaaaataggaaggtggtggttagccttatatttttttattttatctttatccagacacacatcccttaaaagtttgtacaaggccatagtcccctttattagttatactcaattagttattctagcacatagctttttaaatattggccaaaactggctgggcacggtggctcatgcttgtaatcccagcactttgggagctgaggcgggcagatcacgaggtcaggagttcgagaccagtctggctaacacagtgaaaccctgtctctactaaaaatagaaaaattacctgggtgtggtggcaggcacctgtaatcccagctacatgggaggctgaggcagaatacttgcttgaacccgggaggcggaggttgcagtgagccaaaattgcaccactgcactccagcctgggccacagagtgagactctgtctccaaaaaaaaaaaaaaaaaaaaggccaaaacttctccaggagtttggtttctgtgtgtatatatatatattttgggtggggacagggtctcattctgtcacccaagctggagtgcagtggtgtgatcacggcttactgcagcctcaaccttctgggctcaagcgatcctcccctcagcctcttgagtttcagggaccactggcacgtgccaccacacctggctaattttaaattttttgtagagatgagatcttgccattttgcccaggttggtcttgaacttctgggctcaagcagtcctccaccttagcttcccaaagtgttgggattataggtgtgagctgccatgcctggctattgccaaatttaaatggttacatatttcttacttgaatgtgaacataattattgatatagaatcattctaataaatactgcatagccagcttgtctgtctggttcctcatcctaccatgagtagggagtctgtgataccccaaatcagtgggtcacaggtgttggaatttccaaagagtccttcttggttttctgggttctggaaatgggccaggaaaagccaggataaagctatgttccccgacctcgaatggaagcttctggctttctctaaatgggtgctccagaaagacaaatgctggggagaagatgatattctttgatggtgatcatgctttatgatgatctttctccttttgtacccacatgtctaatctattctaagtctcaagtgggtttttccttttttcaaaaaatttttttggagacaaagactacctctgaaagtgtttttcctttctaagtgtgttggatcatctgtacctatttccctggctgtcacctgtctggccctcttccacgtgatcctgttgccagccctaatcaggacaaacctgaatgactagactattttgtgtccctgtcctcctccaacccctattcctcacatgagtgtcagatcctattcagtaacggatttgatctggatttggctctagtcctagctcttccatttactgtgagacctcaggcaagtcacttaatgctatgggcctgcttctccccatttgtaaaatgaggggctgatgatctgcaatgtccaccctggctgaatcttggtcgctaccttgcttagaaaccccattgcctgtggtagcttgttgcagcagatctgatttctttcatgtgctcccttgggcagcctgccagttattcccttgtccaagtcacttctgccattatctttttttctagctgaggcagccagcttgttctcaacccaacttcagcgttcttcttgcttccatgtcttcttccagttccatgctgtatttcattcagaactacctgaaatcctcaaagaagtcttcctgagttctccattcaatgtttgtgacttctctgccttaccaagaaggagtctgtaccttatataccccgtatttacttgtcagttctcttatctaatgtatacttaaaaagggacttcatttcctccataccacagctttgttttttggtttgaattagcagggcaggtggcatgaaatttaaagaggaagcaagcaggttgtttgcctttggctgggatttggggaaagtatgagatgtaatgtttttagtccccttccccaagatctcctgtatctgtgggaatcagttgcctggtatgtcttcctggattgtaaaggtgcttaaacttcctttctgaagtttgaaagtgtatcctaagtgcaaataccatttgacaattactcgtggttgggtgggtgcagtggcttacgcctgtaatcccaacactttgggaggccagagtgggaggattgcttgaagccaggagttcaagaccagcctgggcaacaaagtgagattcctgtctctactcccccaccaaaaacaaaaaagtagtcaggcatggtggtgcgtgcttgtagtcccagctccttgggaggctgacgagggagttcagagtctgcagtgagctaggattgtaccactgcactacagctgggtgacagcacgagaccccattgcttccaagtgctcttctaggaacacacagccacaaaacccagaacaaggaattgttaaggataatgataagaaatctgtatttcaaataacttaacaaatgaataaaaccaacagttctttgagagcacctgattattgtcaaagacagttgctgagggggcttggaagtcaggacttaaaggtatatttaacctctggagttttcttctttcatcatcttcctaagaaataatagggaggatgtttacatttttcttgataaagtctttttattaattttatttatttatttattttgagaaagggtcttgctctgttgcctaggctggagtgtagtggcgcagtcttggcttactgcaacctgtgcatcctgaattcaagcgattcttgtgcctcagcctcctgagtagctgggattataggtgcgcaccaccatgcccaactaattttttgtagttttagtagagacaaggtttcactatgttggttaagctgggacatttttcttgataaacattctttaaaccaaaatgtatgcttagtcaagatccttgattggattatgagcctagagaaaaggagggtgatgtctttgtctaatccatctttgccagtgactgccccttacaggctattgactatagggtaacctaatgaaaattgagacaggcactgtggctcacgcctgtaatcccagcactttgggaggccaagtcggatggatcacctgaagtcaggagttcaagaccagcctggctaacacacagtgaaactccgtctctactaaaaatacaaaaaattagtcaggcgtggtggcaggtgcctgtcatcccagctactagggaggctgaggcaggagaatggcttgaacccgagaggcagaggttgcagtgagccgagattacaccactgcgcttcagcctgggcaacaagagtgaaactgtgtctcaaaaaaaaaaaaaaaaaattgaacccttaatttgtaataatgctttgacaactttgctagatcttgggctaggtcctacctggaccttcctctcttttgccaaataatggaactaatgagctggcagaaatcctgtacaattttagaagcctaatatgagtgactaaatgtaaataggacagttttaggaaagagtggtggagcctgaatcagtgaactttggggaaggagcaagaggaggggcttgggatttaaacaaagggtttttttttgttttgttttgttttttgttttttttttgaggtggagtctcacttcgttgcccaggctagagtacaatggtgcaatctcggctcactgcaacctctgcctcccggattcaagtgattctcctgcttcagcctcccaagtagctggtactacaggtgtgtgccacctcaccctgctaatcttttatatttttggtagagactggctttcatcatattggccaggctggtctcgaactcctgacctcatgatccgcctgccagggcctcccaaagtgctaggtttacaggtgtgagccactgcgcctggcctaaaccaaggtttttattcagtgatagtttattccatgtcaggaacataattctcagattttaaaggctgacttccaggtatcttagaaggatatttgggggtctctgtcctagtagagacctgattttcaagaggtctctttctcatatggaaaaagtccatagctggtggattgacattcctttctttctttttttttttttgttgaggcggagtctcactctgtcgcccagaagtgcagtggtgcaacctcggcacactgcaacctctgtctcctgggttcaagcaattctcctgcctcagcctcctgagtagctgggattacaggtgcccgccaccatgcctgggtaattttttgtatttttagtagagatggagtttcaccatgttcgccaggctagtcttgaactcctgacctcaagtgatccacccgcctcggcctcccaaactgctgggattacaggcgtgagccactgtgcccggccaatgcctttcttgcttctacaggtgcacaggtgttgggatttcgaggttgtggaaacttggtctggaaatgtgggcattttacaataatgataactatagctagcatttttggagcactgtcttaaatgtcattgaatccttacatctgacctattatcctgtcctaacagaggaggaaactgagatgagtaatttgtccaaggtcatttggctaataagcagggcctcgattggagtccaggtttctttgcctcctgtcccagtgctcttacatccctctctctctagctaacgtgctttttcccctagaaatttgagtaagtcattttaactacaaatcaaacaggtggcagcctggaaaccagcactgaggcactttgccaccctcaccccagatttcttttttttttttttttttttttgggacggagtctcacattgttgcccaggctggagtgcagtggcacaatctcagctcactgcaagctccgcctcccgggtttacgccattctcctgcctcagcctcctgagtagctgggactacagatgccctccacgatgcccggctaattttttgtatttttagtagagacaggggtttcgccatgttagccaggatggtctcgatctgctgacctcataatccatccgcctcggcctcccaaagtgctaggattacaggcatgagccaccatgcctggctcattcttttttcttttttttcttttctttttttttttttgagacagagtctgactctgtctcccaggctggaaggcagtggcatgatcttggctcactgcagcctccgcctcccgggttcaagtgattctcctgcctcagcctcctgagtacctgggattacaggcgaacaccaccacacccggctaatcttttatatttttagtagagacggggtttcaccatgttgcccaggctggtcttgaactcctgatctcagatgatccaccagccttggcctcccaaagtgctgggattacagacatgagccactggtgcctggcccttttttttttttttttttttttgagatggagtttcaccttgtagcccaggctggagtgcaatggcacgatcttggctcactgcaacctccgcctcccgagttcaagtgattctcttacctcagcctcccaagtagctgggattacaggcatgtgccaacacgcctggctaattttctgttgttagtagagatggagttttaccatgttggtcagtctggtctcgaacccctgacctcaggtgctccacccacctcggcctaaagtgctgggattacaggcgtgagcaagattttattcttttttttttttctgagatggattcttgctctgtcacccaggctgaagtgcagtgacacgatcttggctcactgcaacctccttctctggggttcaagtgattctcatgcctcagcctcctgagtagctgggattataggcctgcaccaccacatccggctaattttcatatttttgatagagacgggtttcaccgtattagccaggttggtctccgcccgcctcagcctcccaaagtgctgggattacaggcgtgagccactgtgcctggccttcattcttgaccatgcaaaacatcctttaattgtagaagcccagttctcccaactcaagctgcctttctacatttttctttcttcttcaatttttgttgttgttgttgtcgtggtcagatacacataatataaaatttgccattttaaccatttttaagttatatagcttactggtattaaataatgttgtgcaaccatcaccactctccatctccgtaactcctcaaaattgaaactctgggccgggtccagtggctcatgcctgtaatcccagcacttcgggaggctgaggcaggtagatcacttgaggtcaggagttcgaggccagcctggccatcatggcaaaaccccatctctactaaaaatacaaaaattagctgggcgtggtagcacatgcctgtgatcccagccactagggagcctgaagcaggagaactgtttgaacgcgggggcgggtggaggttgcactgagccaggattgctgcactgcactccagcctaggtgacagagcgagactccatctcaaaaaaaaaaaaaattataactctgtacccattaaacactgactccctctttcatgaacctcctcccagccccagcagctaccattctactttctgtctccatgtttttgaatacttttctgccttttttgaggctcctgggcatgactggtttgggttgcttgactgtcccttggttccatggagtattgaattctgtgtaatgtgctttgatgagtaggaaattggtcgtgctgtgacctatatgataattagacatgtgcaacttgtaaaggcaaggtaattaaagaggccacttttctttttcttgttttgttttttttttctttttttcttttttttttcttctctttttgagacattctcactctgttctccaggctggaatgcagtgacatcatctcagagctgactgcaacctctgcctcctggattcaagcaattctcctgcctcagcctcccgagtagctaggattacaggcggatgccaccatgcccggctaatttttgtatttttggaagagatgggttttcaccatattcgccaagctagtcttgaactcctgacctcaagtgatccactctcctcggcctcccaaagtgctaggattacaggccactgtgcctggccaagaggtcacttttcatgtccaggctgcatggtatgtggtggtgaggatgtaggatttggaggtggaatgcctgagtttgagtgcctgtatttgccactctcttggggccaaatgtaatttgggcatatggcttaaacctcttgaacctttcattgtgttatgcacattggaggcagaactttccagcctagcaagttacttaacctatatgagcctgtttcctcacccaagtattatcataactgtctgacatcagtcattggaaatatcagtaaatgttaccctttccctccatttcctaatctgtaaaggaaattaaagaaacctggtttggctgggcacagtggctcatgcctgtaatcccagcactctgggaggccaaggcaggaggactgcttgaagccaggagtttgagaccagtcctggccacagagtgaaacctcatctctataacacagaaaaaaaaaaaattagtttggcatggtggtgcacgccttgtagtcccagctccttgggaagctgaggtggaaggattgcttgaacccaggagttcaaggctgcagtgagctatgatcctgccactgtactccagtgtgggtgacagtgagagcctgtgtttaaaaataaaaaaaagaaaagaaaaagaaaacatagtttatagagttttcctggcttgaagatttatgaggagttgagtatatgttaccattattacttttgttttattcctctcagaaaatgtgtgtaaaattcctccatgggcccttcagtgggccttgttagtttgtatttcatccataactttatcagtagtgtatgccaaagaaaaagactcttactttttttttttctttatgatggactctcactctgttgctcaggttggagtgcagtggcacaatcacagctgtcttgcagcttcaacctcctgggttcaagggatcctcctgcctcatcctcgtgagtagttgggactacaggtgtatgccaccgcgcttggctaattttttttttttttttattatttatagagacgaggtcttgctatgttgcctaggctgatctcaaactcttgggctcaagtgattctcctgcctcggccttccaaagtactgggattggccgggcatggtgcctcactcctgtaatcccagcattttgggaggccgaggtgggcggatcacctgaggtcaggagttcgagaccagcttgaccaacatggagaaaccccatctctactaaaaatacaaaaaattagccgggcatggtggcacatgcctgtaatctcagctactcttgggaggctgaggcaggagaatcgcttgaacccaggaggcggaggttgtggtgagccgagatcgtgccattgcactctagcctgggcaacaagagtgaaactccgtcttaaaacaaaaccaaaccaaagtactgggattataggcatgagccactgtcccgcccttacgtttgtttgtgtgttttttttttttttgagacagtgtatcgctctgtcccccaggctggagtgcagtggcacaatctcggttcactgcaacctccacctccagggttcaagcgattctcctgccttaacctcccgactagctgtgactacaggtgcctgccaccacgcccggctaatttttgtatttttagtagagatggggtttcaccatattagccaggctggtcttgaactcctgaccttgtgatctgcctgcctcggcctcccaaaatgctgggattacaggcgtgagccactgcacccggccacattttttttcccctcattttcacacacacaaaactaacagtaatcccttaatatttttaatgttgaaatatcccaaagactttttttttttttttttttttgagatggagtctcactgtgtctcccaggctggagtgtggtggcatgatctctgcttactgcaacctctgccttccgggctcaagagattctcctgcctcagcctgccaagtagctgggaatacaggcgtgtgccactatgcccagctaatttttatgttgttaacagagatggagtttcaccatgttggccaggctggtcttgaactcctgacctcaggtgatctgcccacctcagcatcccaaagtattgggattacaggcatgagccactgcactcagtcccttgtttttaaaagcaataaaggttagtgggggccgggtgcggtggctcacacctgtaattccagcactttgggaagcttaggtgggcagatcacttgagctgaggagttcgagactagcctcggcaatgtggcaaaaccccgcctctataaaaaatacaaaaatgaggaaggggtggtggcacgtgcctgtagtcccagcactgggggagctgaggtggggaggatggtttgagcctgggaggcaaaggttgcagtgagccaggatcatgccgcttcactccaacctgggccacagaaacagaccctgtcttaaaaaaaaaaaaagagggtagtgggttttggaggaaggaggtcttgcttctgaagtcccagctcttctatctagccaggtgactttgggcaagttgtttattgtttatactccttcgtaaaatactgctgacttctctgcattgttgggaatgagatgtttgtcaaggatttagcatgtggtgataaatcagtaaatgttgaatatttcctggtattaataataaaggctaggaataaaaattcatacttaaaggaaaatggacttttatttatttatttatttttgagacagagttttgctcttgtcacccaggctggagtgcagtggcacaatcttggctcactgcaacctctgcctcctgggttcaagcgattctcctgccttagcctcccgagtaggtggtgctacgggctcctaccaccatgccgggctaatttttatatttttagtagagatggggtttcaccacgttggccaggctggtctcgaactcctgacctcaggtgatcctcccgcctcagcctcccaatgtgctgggattactggtgtgagccaccacaccctgccaagataagggaattaatgaattgtctcataaatatcttaggtatttaaaactccataggcatgaaaatgtctctcaaggccctgttgagtaatgatttcatctccaaattgttttcctttgtaatatggtgatatttcaattaagaaattctgtaagaataggccgggtgtggtggctcacgcttgtaatcccagcactttgggaggctgagaccagcctggccaacacagtgaaatcccgtctctactaaaaatacaaaaaattagctgggcatggttgcaggtgcctgtcatctcagctacttgggaggctgaggcaggagaatcgcttgaacccgggaggcggaggttgcagtgagctgagattgcaccactgcaccccagcctgggcgacagagcgcaactccatctcaaaaaaaaaaaaaacaaaaaaaaaaacaaatcttgtaaggatagctggtcaggtgtgtttaaaaaaagacttcccagctgggcgtggtggctcacgcctgtaatcccagcactttgggaggccgaggcaggtggatcacgaggtcaggagatcgagaccatcctggtcaacatggtaaaaccccgtctctactaaaaatacaaaaaaaaattagttgggtgtggtggcgtgtgcctgtaatcgcagctactcaggaggctgaggcaggagaatcgcttgaactagagagttggaggttccagtgagccgagatcgcgccactgcattccagcctggtgacacagcgcgactccgtctcaataaataaataaataaataagacttcccctaggctgtgagcagtggctcatgcctgtcatcccagcagtttgggaggccgaggcgggtggatcacaaggccaggagatcgagactatgctggccaacatggtgaaaccctgtctctactaaaatacaaaaaattagcccagtttggtggtgcacgcctgtagtttcaactacttgggaggctgaggcaggagaatcacttgaaccaaggaggtggaggttgcagtgagccgagattgagccactgcactctagcttggcgacagagcttgactccgtctcaaaactcactccagagctatagactatatcactcagagagtgtagagtattgatagattggagcccccagtgcctgaagaaatggatacagcttttcttaagccccagggataaaactgtgatcagtcttcagttgcttcattccgcatgctttgccttcctctgcacgcaaggagtaataatagttcccacgtttacctgtggataacactcttcaaagaacctccatgtgattatcttcttgaatctatatacccattgaggtggatgatattgatctctttcctgttttttttttttttttttggagacagggtctcttgctctgttgcccaagctggagtacggtggtgcaatcatagttcactgcagccttgaacccctgggctcaagtgattctccagcctcagcctcctgagtagctaggacgacaggtgtgtgtcactgtgcctggctaattatttatttatttatttatttatttatttatttatttcagacagagtttcactcttgttgcccaggctgcagtgcaatgatgtgatctcggctcactgcaacctctgcctcccaggttcaagcgattctcctgcctcagcctcttgagtagctgggattacagggatgcaccaccatgcccagttaattttgtatttttagtctagacgaggtttcaccatgttggtcaggctggtctctaactcccgatctcaggtgatctgcccgcctccacctctcaaagtgctgggattacaggcgtgagccaccgcgcccagcctatttttttatttttatttttactttttgagacagagtttcgctctgtctccctggctggagtgcagtggcacaatctctgctcactgcaatctccgcctcctgggttcaagcgattctcctgcctcagcctcccaagtagctgggattacagggaagcaccaccatgccagttaattttgtatttttagtctagacgaggtttcaccatgttggtcaggctggtctcgctctgtgcccacctctgcctctcaaagtgctgggattacaggcatgagccaccgcgcccagcctatttttttatttttatttttactttttgagacagagtttcgctctgtctccctggctggaatgcagtggcgcaatctttgctcactgcaacctccgcctgggttcaagtgattctcctgcctcagcctccctggtagctgggattacaggcccttggcaccacacccggctaatttctgtgtttttagtagagtcagggtttcaccattttggccaggctggtcttgaactcctggccttaagtgatccacctgccttggcctcccaaagtgctgggattacaggtgtgagctacctagcgcagctctatatttttatttatttgtttatttatttattttttgagacggagtcttgctctgttgcccaggctggagtgcagtggcgcgatctcggctcactgcaagctccgcctcccaggttcatgccattctcctgcctcagcctcctgagtagctgggactacaggcgcccgccaccacgcccggctaattttttgtgtttttagtagagacagggtttcctcatgttagccaggatggtctcgatctcctaacctcgtgatccaccctcctcggcctcccaaagtgctgggattacaggtgtgagccactgtgcctggcctattttttttattttttgtagagttgagatctcactatgttgcccaggctggcttcaaactcctggcctcactcaagtgatcctctcaccttggccttccaaagtactgggattacaggtgtgagcaattgcacctggcctcttttctgtttttatttccattttgccagtgagaaggctgaggttacctctttttttttgagacgtagtctcgctctgttgcccaggctggagtgcaatggcatgatctctgctcactgcaacctccacctcccatgttcaagcgtttctcctgcctcagcctcctgagtagctgggattaccggtgtacaccaccacgcctggctaatttttgtatttttactagagatggggttttgccattttagccagggtgttcttgaactgacgtcaggcgatccacccaccttggcctcccaaagtgctgggattactggcgtgagccaccacgcctggccaggttatatcatttaacaaacatttgaccaccatgttaagggcactgcttgttagatgctggggatgcctatgaggagttaattgcctcttgggagagatctgcttagataggcagtttcagcatagagtgatgaatgctgtggcccagagggtaggttaggttgccatgggagaatgcaggtgtgaaggaagtccttcagggaggttccaatggctaatcctggtcatgaaggaccaggaagagaaagcagcttgtttggccaggtgcagtggcttatgcctttaaccccagcactttgggaggcttagtgagggagggggcagatcacctggtcaggagttcgagaccaccctggccaacatggtgaaactagagactagcccgtctctagtaaaaatacaaaaattagcctggcatggtggcttgctcctgtaattccagctacttgggaggctgaggcaggagagtcgcttgaatctgggagacagaggttgcagtgagccaagattgtgccattgcactccagcctgggtgacagtgcaagactccatcaaaaaaaaaaaaaaaacaaaagcagcttgtttatacaaaggccctggaggtcggaactgcagggtgtttggatgtggcaggagtatgggtggtaagaacagtaataacccttttttctttttctttttctttttttgtgacgcagtcttgctctgtcttccaggctggagtgcagtggcgggatctcggctcactgtaacctccacctgccgggttcaagcaattctcctgccttagcctcctgagtagctaggactacaggcgtgcaccaccatgcctggctaattttttatatttttagtggagacagggtttcaccatgtcggctaggctggtctcgaactcctgacctcatgatccgcctgcctgtgccccacaaagtggtgggattgcaggcgtgagccatggcgcccagcccccgcccccccccccccctttttttttatacacagttttactcttgttccccagtccggagtgcagtggctcgatctcagctcactgcaacctccgcctcccgggttcaggcaattctcctgcctcagcctcctgagtagctgggattacaggcgtctgccaccatccccagctgatttttttttgtgtttagtagagatgggttttcaccacattggccaggctggtcttgaatttctgatctcaggtgatccgcccgcctctgcctcctaaaatgctagaattacatgcatgagccaccatgcccagcaagaacagtagtaaccctgcaagcttattgtgtgccaggctctgctaaataacttttttttttttgacggagtctcgctctgtcatcccggctggagtgcaatggtgtgatcccggctcactgcaacctctgccttttgggttcaagcgattctccttcctcagcctcccctgtaggtgggattacaggcgcatgccaccacgcctggctaattcttgtgtttttagtagaggcgggatttcaccatgttgacaaggctggtctcaaactcctgacctcaggtgatccgcctgcctcagcctcccaaagtgctgggattacaggtgtgagccaccgggcctgacctgtgctaataacttttatcttcacaacacctatatgatggtttgaagtaggtgctggtgatatcctcattttacagatggggagcctgaagctcagagaggaaatgacttgtgcaagtttatctggaaagtggtggggctgaggtccaaactcaggcactcttattccagagttctggctcataaccgctgtgtcccacagcccctctgctaaagcttgcctgcttctctccttttaagctccaaaagagagtttcttttggcttggttataatggctaactcactaatggcccaaatgctgcgctgagtaccttgaatatggttctgtaggggagccgctgaactgttttttttgtttgtttgtttttgttttttgagacagagccttgctctgttgcccaggctggactgcagtggcgcgatcttggctcactgcaacctccacctcctgggttcgagcgattctcctgtctcagcctcctgagtagctggaattacaggcgtgtgccaccatgcccggctaatttttgtatttttagtagaggcgaggtttcaccatgttggccaggctggtcttgaactcctgaccttgtgatccacctgcctcagcctcccaaagtgttgggattacaggcgtgagccaccgcgtccggcctgaactgttttaaaatagaagtcttatgatcatacttacattttagaaatatcactgtagcagcagtgatgaagattggcaacagtgtaattaactggagtcagccttacctcggttcaattccttgtcccaatacctgactagccttggtatttgggaaacttactttgtgaacctcagttttcacatccataaaatgggaataatcctcattacaaacctaagaggtagacactaaatgggctgatatagtttttatatatatgtatatatataccagaatagtatctatctatctatctatctatctatctatctatctatctatctatctatctatctatcttagaatagtatatacatatatatcttagaatagtgtatatatatatatatatatatatatcttagaattgtgtgtatatatgtatcttagaatagtatttgtcataaaataaccactgagaagatgtcatctcatgagacagtattgatttggatctggggaaggtatagctggaggattggagctctgtcaagagctgctggagtaatcaagattagaactgatgcagggctgaactgggcatccacttggcaatggctgagacttagaagcaggtcctacaaaatgttgtccgagtgtgggaggtgagggaaggagaaggaggtaagggaagtgcccatgtttctagtttggcacacttgccaatcttgagggcttatttgatggggacaaaaggagaaggaacttgtaagggtaagatgattagctcagtgaaattgagtaatatgcgaaaggtcatacagcagatacattttagggccaaccctggcacaggccctttccactgcttctgggaaaatccactgatttaatcgactcattctcagtagtttggaatgagtaaactcaactcatgtttgctgtctctttgcattttaattatggaaggcaaagcttgactcttgcagaaagcatttcaagtatctgggaagaaagtgggtgaagttttgaggcctatttctttcttcactcttcttttttttacgacagagtcttgctctgtcgccaggctggagtgcagtggctcgatcttggctcattgcaacctccaccttctgggctcaagcaattctcctgcctcagcctcttgagtaactgggattacaggcacctgccaccacgcccggctaattttttgtatttttagtagagacggggtttcaccatgttggccaggctggtctcaaactactgaactctggtgatccgccctcctcgacctcccaaagtgttgggattacaggcgtgagccaccgtgcctggcttcttccctcttttcattcttgcctgcccttccttccttcctttctttttcttcctccttacctcttctgcctttcctccctccttccctaccttgtcaagtaaaagggactaattccctttcttctagtgtgacctgggaagaggtcctacttgaaccaatttgtcacttccctacgactaaagatacgctctttatgcactttagtatattggatactgtttgttaatttttaataatattgactataattctttgtgtctgatgtcctttttgctagtataccaccattgccatcaccagtaccatttagagtttgctatgctaagcacttgacatccattagctcacttattcttcacaacaaccctaggaaattggggctgttgatcccatcttatagctgggcaaacaggctcagtgatttttcttgtcgtcgctcagccaacaatgcctggagccagaattggttagaatctgagtctaaaacctgtctgtgcacccatccctaggcattccctggccttcctccacggcagaactttggcaaaaggtcctcttggaggcttcttcctgggagacccaggtatcactggaccggctaaaattgtttatgctttcttgggacagcagcatgggctgtgggaagtctcaaccttctaggttcaagctgtgtgtggggaaagctcctttctgccggagattctttgcctgtagtagttgcctttgcttagaagtcacttcctttagatctccttcttgtcacctagttctctgcttagacctcagttcctcagagagtcctttctttttctttttttttttttttgagacaagagtctcgctctgtcacccaggctggagtgcagtggcatgatcttggctcactgcaacctccacctcctgggttcaagcaattctcctgcctcagcctcccaagtaggtgggactacaggtgcccaccactaagcctggctaatttttgtatttttagtagagacggggtttcaccatattggccaggctggtctcgaactcctgacctcaggtgatccacctgcctcggcctcccaaagtgctgggattacaggcgtgagccattgtgcctgtcttgagagtcctttctaacagccgtatctaaaatagtcctttccatgtcgctggttcacattattttgttgtttttcccacaattacttatctctgtcagaaatgatctttatatgctcgcatggcgcagtggctcatgcctgtaatcgcagcactttgggaggctgaggttggtggatcactggaggtcaggagttcgagaccagcctggccaacatggcgaaacactgtctctactaaaaatacaaaaattagccaggcatggtggtgcacgcctgtaatcccagctactggggagggtgaggcaggagatgcttgaacctgggaggcggaggttgcagagagccgagattgcaccttgcacgctgggctgggcgacaagagcgggactctgtctcaaaaaaaaaaaaaaaaaaaaaaggccaggcgcggtggctcacacctgtaatccccagcactttgggaggctgaggtgggtggatcgcctgaggtcaggagttcgagaccagcctgaccaatatggagaaaccccttctctgctaaaaatacaaaaattagccaggcgtggtggcacatacctgtaatcctagctaccaggaggctgaagcaggagaatctcttgaacctgggagatggaggttgcagtgagccgagatcgtgccactgcactccagcctgggcaacaagagcaaaactctgtctcaaaaaaaaaaaaaaaagaaaaaagaaatgacccttatgtatgtgcttatcttgtttcttagctgccttccccactagagaacagggtccgggtgccttgtcctcccattgtctatttccagtacctggcacacagcaggctctcaatgaatatttcttgaatgaggggggcataaagatttaagctggtctttcacctgaagtgtccctcaatttaaagtggttgtattgagttaaaaggcactgtcaccctttaatggaggttgaatcccagccttgtggtgagcaccattagattatcccaaagcctgttctgtagtttctggtggttggcattttattccttgagagtcccagagacttttttcctcgaaagttccagagtttatttccctctactcctgtcccagagctgattcactgaaaggtcttgttccatacccatctatcacttttaattctttgttgtccctcttttccctgagcacaaagggattgctgagggcaagacttccagttaccatagcgacagtactcttttgcctctcccaaaataaaacccagagtctttgtcagtacattaactgtaaatgtgatatgaattcagaaaatatgggcgtggtggctcacacctgtaatctcagcactttgggaggctgaggtgggcaaatcacctgaggtcatgagtttgagaccagcctggccaacatggcaataccctgtctctactaaaaatacaaaaattagctgggtgtggtggtgtgctcctgtaatcccagctacttgggaggctgaggcaggagaatcgcttgaacccgggaggaggaggttgcagtgagctgagattgcaccattgcactgtagcctggggacagagcgagactctgtcttaaaaaaaaaaaaaaaaggaagaaaaatctgctatcatttattgagtacctacttgtttttttttgagacgaatctcactctgatgcctgggctagagtgcagtggtgccatcttggcttactgcaaccttcatcccctggttcaagcaattcttctgcctcaccctcctgagtagctgggattataggtgtgtgccatgatgcctggctaatttctgtatttttttagtagagacagggtttcaccacattggccaggctggtctcgaactcctgacctcaagtgatctgcccactttgccctcccaaagtgttgggattataggtgtgagccactgcgcccagctgactacctactttgtgttagatattttaataggggttttgcagacctttctcatttaattctcatagcacccacgataggggccattatccccatatcataagtgaagaaacagagctcaacaatgtagcttgtaaataaacttggggtaagaatctgaactcaggagctactggactgaggttcgattgctggctcagctccttactatgtgagtgtccttaactttctttttcctcatctttataatggggattaatatagtacttctgtgatttttgtaaggattaaattggttaatatatgtaagtttaattattataaattttttttttgagacagtctcactctgtcgcccaggctggagtgcagtcgtgtgatctcagctcactgcaacctccacctgcagggttgaagtgattgttctgcctcagcctcctgagtagctgggactacaggtgcgcaccaccatgcccagctaatttttgtattttttagtggagacggggtttcactatgtttacctgggtggtcttgatctcttgacctcatgatccgcccgccttggcctcccaaagtgctgggattgcaggcgtgagccaccgcacccagactatacattttttttttatgcgggttttgttagtttggataaggttattttacatctactctctgtaaagttagtttatatctttatcatagtagtagcttaatagcattctttatttaatttattacatatttgttgagtttataatgtagtcctactgtaatgaattttgattaaatattctcttgttttttaatggatgaactacatccagtttgcccagaatcttatgtaaagagctattggtttttctcattttcacaaatgatttatttttatcctggactgtattcttcagcttgaaatggctgagtccaagagtataagcagttccacaggttgttctttgcttctagattaaggtataaaaagatggccatggtcaggaccccaggaggtgttctagtgtacctgtttccccacagctggaccagtgttaggttttgtcttttctaaaaaattaggtatttctgcttgttatataatggtgtgataattttgacacaacatttgaaaagcatccagttgctttatcttcctgtattcaagttatgtttatatctaaagatatgaatataagcatagcaacgactttggtcagagaaagaggaaggacctttgagaagtactttgtctacttctgcgtacatcctgttacttttgataagagggatttctcctgcctcagaggaccttgaaattggctagcacctctgcatgtcagtttcctccctgtaacttaattttacttgtataccatggtaacattacattagtcctaattatataatctggcagttgtgaagatccagtaaatagtaaaatagtgtaagaattaaattcttgcatttaaaaaatttgcaggtttttttttggattttttgtagagatgacatttcaccaagttgcccaggctggtcttgaactcttagattcaagctacctgccccttggcctcccaaaatgctgggattacaggcatgggcctatactcagcctcccaaagtgctgggattataggcatgagccagtgtacctggccaaaaatttgcatatttaaataaccttaaaagaaaaaaatgggccgggcgtggtggctcatgcctgtaatcccagcactttgggaggccaaggtgggtgcatcatttgaggtcaggaattcaagaccagcctggccaacatggtgaaactctgtctctactaaaaatgcaaaaattagctgggcagtagtggcatatgcctgtaatcacagctactcaggagactgaggtgggagaattgcttgagcctaggaggcggaggttacagtgagctgagatcgtgccactgcactccagtctgggcgacagagtgagaccctgtctcaaaaaaaaaaaaaagaaaaaaatatgaagaaacataaagaagcaaccccaccaccagaataaaataaaattttatcatctagataattcctgctgacaattacttctttggtggttttttttgtttgtttttgttttttggcttttttttttttttgagatggaatcttgctctgtcacccagactggtttgcagtggcacgatgtcaactcactgcaacctccgcctcctgggttcaagtgattctcctgcctcagcctcctgagtagctgggattacaggttcccaccaccatgcccggctaatttttgtatttttagtagagacggggtttcaccatgttggctaggattgtctcgatctcttgaccttgtgatcctcccacctcgacctcccaaagtgctgggactacaggcatgagccactgcgcctagcctggaatgggttgtttaatagatagcttattgtccttcacatgtataatcctttacattatacacttgtgaaaaattttcattgtgaaaaactaaaatttaggaaagtatttaagaagaaaggaacaatcaccaataacctataacttatttttttcttcctgtctttacaaaagaatcagtggctgggtaccatggctcatgcctctaattccagcactttgggaggctgagtcaggaggatcacttgaacctgggagtttgagaccagcccagacaaacacatagcaagaccctgtctctaccagataacaaattagctgggtgtggtggcttgcacctgtagtcccaggtgcttgggaggctgagtaaggaggatcacatgagcccaggaagtcgaggctacagtgatccaggtttgagccactgtagaccagcctgagtgacagagtgagcaagaccttgtctccaaaaaaataaattcatatgagtttttttcttttcttttcttttcttttttttttgagacagaatttcactcttgttgcccaggctagaatgtaatggtgcgatcttggctcactggaacctccacctcctgggttcaagtgattctcctgcctcagcctcccaggtagctggaattacaggcatgtgccaccatgcctggctaattttgtatttttagtagagacggggtttctgcatgttggttaggctggtctcaaactcctgacctcaggtgatccggcagcctcggcctcccaaagttctgggattataggcatgagccaccatgcctggccttttttttttgtttttgttttttaaagagacaggttcttgctctgtcactcaggctggagtacagtggcacaatcataactcactgcagtctcaacctcctgggctcaagcgatcctcctgcctcagccttttcagtagctgggattataagcctgagccacctcatctggctgtgtatgagttttaatgtgagctccatgtggtacaattttgcatcctgcctttttatgtaatatattgcaagcaaattcttcataaaatgtgctgctattaaacattagacatgtactcacttctgtgatttttttccatactcatttattgcaaagaaagtgttctggtaggaggcaggcattgctctggcagtgctctggcattgcttgggcagtgtaggctgtcaagagccaaagtataaggctggatgcagtggctcgtgcttgtaatcctgtaatcccagcactttgggaggcccaggcgggaggattgcttgaacccaggagtttgagatcagcctaggaacatagatactctctctgcaaaaaaaaaaaaaaaaaaaaaaaaaaaagctgggtgtgctgacgcatgcctgtgattccagctactcgggaggctgaggcaggagtattgcttgagcccaggagtctgaggctgcagtgagctatgatagcgccactgcattccagcctggacaacagaatgagaccctgtctaaaaaaaattttaaaaagtccagagtttagtgggaggaaagagttaggctggggtaagtctgctgtaaggaagtggcctgttcaagtgcccttagagttcagagtggctacatgtccatcagaaccaccactagctcctccgatagcatttaggaccctgcagattagtagattaattacctcagtgatcacaagaagtgttctttttttttttctttttcaagatggagtcttgctctgtcacccaggctggagtgcagtggcgtgatctcggctcactgcaacctccgcctcccaggttcaagctattcttctgcctcagcctcccaagtagctgggattacaggcgcctgccgccgcgccccactaattttgtatttttagtagagatggggtttcaccatgttggccaggctggtctcaaactcctgaccttgtgatccgcctgcctcggcttcccaaagtgttgggattacaggcttgagtcaccgcacccggccggaagtgttcttttatgggggccacttttcttgtaaatggcctaatccagtacaccttttttttccatcaaaaggaaattggctttactgtttggttctgatcataaatataaattttattcattgcagcacgagtacacgagacaggattgagaaaggagagattcaaattgtgacttcagattcaaaggcaattaaaggaattaaacgtgaatatttttactgttttattgttctatgattaaaaaaaaatctgggtaaaacttataggaaaatacaaatgatcagaatggactcaagaagtaggaaatatagctgggcatggtggcaggtgcctgcaatcccagctacttgggaggctgaggcaggagaatcacttgaacccgagaagcagaggttgcagtaagccgagatcatgccattgcactccagcctgggcgacaagagcgagactcctcaaaaaacaaaccaacaaacaaaaaaagaagtaggaaatatacatagatcaaagaaagtataaacaattctgggcgcagtggttcacgcctgtaataccagcactttgggaggttgatgtgggcagatcacttgaggtcaggtgtttgataccagcctggccaacatggtgaaacccaatctctactcaaaatacaaaaattagctgggtgtggtggcatgcgcctgtagtcccagctactcaggaggcctaggctccagaattgcttgaacctgggaggtggaggatacggtgagctgagatggcaccactgcactcagcctgggtaaaagagtatgactctgtctcaaaaaataaataaataaacagacctcgtacagccttccaaaagtagcaccaagtattaatatctcaacttttgtttgcttcgtttttaattttttttgtttttaagagacgagcgtttgctatgtttctcaggctggtcttgaactcctgggctcaaagaaacaacttggctctgccttccaagtagctggggctataggcatacattactgtgcctggcatttgtttgcttcctttgtaactctttaaatttcattgcaattacagtttgcagttatttatcagtttgctggctaaatttttgtgtttccccggtagactgaagggttcttgagggcaggagctgtgtctcttttggtcttgattgtttccttaaatagtcgctgagcaaatatttgttgaataatgcatcagcagatgactgaatttaactgtgaaagcagttgtttttttgtagttctgaggggtggcccttggcccttgtaggtgagtggtaagcagtgttgagggagggtcttcttagttccagaaaccacaggaagctgcacgatggaggaataggaaccagtggaagacacacctgtgttagaatgaggacaccaacagggtttcatggagctttgtgttttgaataatgcctgtttttttatgtgtagtgaatgatgctacactctgggtggactttgcctaagtttcataaatatttaattggctttttcaggagaataaaggcagccccgttgatgactgaaaatgacaaagcatccacctaacagacgaggaatcagctttgaagtgggagcccagttggaagcccgggaccgtttaaaaaactggtacttttacatttttctgttaattaaagcccttcagtaaaggatttttgccagcactgatagagtggtagcttaggctttttttgtggtgtttttctacttcctgactcttggaagatgtgaggaaatgtcagtcttttctctttgatgcagggatcccagtgtcagggtgactgtcctgtaaccccctgtatatatttgtttcccccttttgcctgttcatctgaaagagttctgggaaaaagaagcaggaatggctacagggaagggaagagttaatagtggcagctctcttgctcctggctgcctgtctgaaaaaagaggaaagatcagggatggaatagtgaagaaaaaggggttcgattggagcagctcatgtgttgtgaacaccccatcctattttctgggcatgatcttgtatgttgaaatacagtcatcatgtaagggcacactgtcagggtgattaggttcagaagctgaggggttatagtcccagctgtgtcattgacttgtgacctctggctggtaattagctgctttgtgcattggcttatctataaatgtgggtattggtaatattgacctcatagggttattctgagaatcaaatgatagaatatgtaaggaaagaccttatagactgtgaagtgattgttgtggttgagggcatcctagaatttggtcattttttggtgctcaaggtgagcgtggggttttcagaacttatacctctttaagggtttttgttttttttttttagacagagattcgctctgtcacccaggcagatcttggctcactgcaacctctgcctcccaggttcaagcagttctcgtgcctcagcctcctgagtagctggtattgcagatgtgtgccaccatgcctggctaattcctttttgagctaaagaaggaagagtttaaccctttttgagattctttcaaaatagattgatcagctcttcaggtgtaggaagataagacaggagaagagaggcatagaagcagctggtacagaaaactgtctttgctattagaattaggtacacttggctgggcgcggtggctcacgcctgtaatcccagcactttgggaggccgaggtgggtggatcacctgaggtctggagttcgagaccagcctggctaaagtggcgaaaccccgtctctactaaaaatacaaaaaattagccgggcatggtggtgcatgcctgtaatcccagcttctcgggaggctgagccaggagaattgcttgaacccgggaggtggaggttgcagtgagccgagattgcaccactgcactccagcctgggcaacagagtgagactcggtctgaaaaaaaaaaaaaaaaaagaattaggtacacttggccagttgtggtggctcacgcctataatcccagcactttgggaggctgaggtgggcggatcacgaggtcaggagttcaagaccagtctggccaacataatgaaaccccgtctttactaaaaatataaaaattagccgggcatgatggtgcacgcatgtagtcctagctactcaggaggctgaggcaggagaatcacttgaacctgggaggtggaggctgcattgagccaagatcgcgccactgcactccagcctgggtgactgagcgagactccgtcccggaaaaaaaaaaaaaagaaaaaagaaaaaataattaggtaattaggtacattttcaacacagttgtttttgggctattttttttttttggagacaagagtcttgctctttcattcaggctggagtgtagtggcgtgatctcggctcactgcagtctttgcctcctaggttcaagcaattcctctgcctcagccttctgagttgctgagattacaggcatgcaccacgatgcccggccaattttttgtatttttagtagagacagggtttcaccatgttggccaggctggtctccaactcctgacctcagatgatctgcctgcctcggcctcccaaagtgctgggattacaggcgtgagccaccaagcctgcctgtttttgggctatttgtattatctataattagttccttttttggtttcagtatatatatatgtgtgtgtgtgtgtgtgtgtatatatataatatactgcgtgtgtgtatatatattatatattgtatgtatatatattatataagtagtatcatacaacttgttttttttctgtgtctttgttttttatattcaatatgtttttgtgatttacccatacttaactccgcaccctcctcgcccacccctgatatagggtcttactctattgctcaggctggagtgtaatggcacaatcatagttcactgtggcctccaactcctgggctcaagtgatcctcctgccttagccctccatgtatctgggactacatcttaacttctgtatagagttttattgtatgaatataccacattttgtttatctagtcccctactaatggacgtttgtttgtttgtttatttatttatgatggagtctagctctgtcacccaggctggagtgtggtggcacaatcttggctcattgcaacatccgcctcctgggttcaagcagttcagcctcagctgggattacaggtgcccaccttgccaagctactgtatgttttttttttttttttttttttgagacgtagtcttgctcagtcgcccaggctggagtgcagtggctcgatctctcctcactgcaagcactgcctcctgggttcacgccattctcctgcctcagcctcccgagcagctgggactacaggcacccaccaccatgcccaactaatttttttgtatttttttagtagagacggggtttcacggtgttagccaggatggttgcgatctcctgacctcgtgatccaccctcctcggtctcccaaagtgctgggattacaggcgtgagccaccgcgcccagcctaatttatgtacttttagtagagatggggtttcgccattttggccaggctggtctcaaatttgtgacctcaggtgatccacccaccttggcctcccaaagtgctgggattacaggtgtgagccaccgctcctggcccgtttatttatttattattttttattgtatttttttttaaatgggtgcttaaattccagtttttcacctgagacacagtgctgtgtgaatgtctctttgtgcacatacacagacttttacttgggcagtggcttttgaccacaacctacagtaagaaatgtattttaaatccagtgtggtactcaaccatatgtacataaaaatttatttttattttgtttttattattatttttttgaaacgctgtcgagacagcgtctcactttgttgcctaggctgtaatgcagggtcgtgatcttggctcactgcaatctccgcctcccaggttcaagcgattctcgtgcctcagcctcctgagtatgtgggattataggtgtgtgccaccatgcctggctattttttttttatttctagtagagccggtgtttcaccatgttggccaggctggtcttgaactcctggcctcaggcgatctgcccaactcggcctcctgagtgctgggaccacaggccagatccatggcacccggcctatttttatttttccagacaaggtctcattctgttgctcaggttggagtgcagtggtgggaacagagctcattgcagctttgacctcccttggcttaagcagtcctcctgcttcagctgggaccacaggcacatgccaccacgcctgattttttattattattattattattattattattattattattattattttgagatggagtcttgctctgtcgcccaggctggagtgcagtggcgcaatctcggctcactgcaagctccgcctcccgggttcacgccattctcctgccttagcttcccggctaattttttgtaattttagtagagacggggtttcactgtgttagccaagatttacctcgtgatctgcccgccttggcttcccaaagtgctgggattataggtgtgagccactatgcccagccacacgcctgattaatttttaaatttttagtagagatgaggtctcactatgttgccaaggctgatctcgaattcctgggctcaggtgatcctcctgccttggcctcccaaaatgctggggttacaggcataagtcaccatacctgatctatataaatttaactgaaacacaaattttatgaagtagtatttaaccttaatacatgcattatactctggtatttttttcagttcttttttttttcgtttgggacagagtcttgctctgtcgcccagtctggagtgcagtggcacaatcttggctcactgcaacctccacctcctcctgggttcaagcgattctcctgcctcagcctcctgagtaactgggattacaggcgcccgccaccacacccagctaatttttgtatttttagtagagacagggtttcactgtgttggccaggatggtctggaactcctgaccttgtgatctgccctcctcagcttcccaaagtgctgggattacaagcgtgagccaccatgcctggcatttttttttttttttttttgatatgtctcactctgttgcctaggctggggtgtagtggtgcagttacaactcattgcagccttgacttccaggctcaggtgatcctctcacctcagccttctgagcagatgggactaccagcacataccatcatgctaggctaattttttgtatttttagtggagatgaggtttcactatgttggccaagctggtcttgaactcctgacctcaagtgtttcacctgcctcggcttcccaaagtgctgggattacaagcgtgagtcaccatgcctggcacatatttaggtttttaatccacctggaattcattttatgtgtagtatgaacttgtatctaattattattttttaattcaatgaataaccagttgctccaatatcatgtttagaatagtccattctttccctattgacctgcaataccacttgtatgtactaagcctcatatttacataggcctgttctcagatctttagtctattccattgatttatgtttactcctgtgcttgtaataacacattatttaattgatattgctttaacataactcttgatatctggtaagacaggttttattttatttgttgtattcttagacctttactcttttttttttttttttttttttgagacggaatcttgctcagtcgcccaggctggagtgcagtggcacgatcttggctcattgcaagctccgcctcccgggttcacgccattctcctgcctcagcctcccgggtagctgggactacaggtgcctgccaccacgcccggctaattttttgtatttttagcagagacggagtttcactgtgttagccaggatggtctcgatctcctgaccttgtgatctgcccgccttggcctcccaaagtgctgggattacaggcatgagccactgcacccggtcaacctttactctttaatgtgaatttttgtagtattgttgagtgtcttgaaaagtgtttttggagttttgaagtaaattgtatttaattggtatcttgataaaaagttttcattcatgaaaatacatctttatacttattcatgttttactttatgaactttagtgatgttttataacctccataaagattttgcatgttatctgttagatttattcctaagtactgtctagtttttgttgcttctatgaatggatcttttttttttttttttttttgagatgaagtcttgctctgtcacccaggctaaagtgcagtagagcgatttgggctcactgcaacctccgcctcccaggctcaagcagttctccctgcctcagactcccgagtagctgggattacagatgcccgccaccatgcctggaatttttgtatgttttagtagaggcggggttttgccattttggccaggctggtcttgaactcctgacctcaggtgatctgctcacctcggcttcctaaagtgctgggataacaggcgtgagccactgcacctggccagatctttatatatatattttttctctttggttattgctggcatgaaggaatattgttaaccaaattcagtatgtggattttatatagtttgaaaacaaaagcagactgcttaaaaaagatttatgacatttatgagattgttggaagtttgaacattgattggttatttgatattaaagaatcgttaacattttagatgtggaagtgatattgtaattttgttttttaagagttcttatttcttagagattatatacctacatttatgaataaaatgatacattgtgatttgcttcaagataatatgaagattctgtaattatatgcagtaggaagaaaaaggagataatatgaagggggaaaagggtgggaagatagaggaagcaaaagcggccatgtgtaatgggtacatgagtctttattgctattgagtcttgtatctggtcttacacagaaacctttctccattttcatgttcatcttaatggttcttttggattttctacatagaccatcatgtatctgcaaacaactgttttgcctcttcctttccaatcctctgcttctcatttcttttcctttcttccttccttactttttttctttccttcccgttttcccttctgtgttcattgactaggatcatagcagcaagatgttaaatgacagtgatgatagcagccttccatagtttgttgtttgactttaacaggaacgcatccgagagttcaccattaagtatgatgtttatcataggatcatagtagatgtgtttagtcagattaaagaagttcatgcctattccttgtttgctggaagttttttttttttcagcctgagtaatgttgaatttaatgcttttgggcatctaattaactggccatgcgtattttcccctttaatcttcatttatttatttatttttatttttattttttgagacggagtctcgccctgtctcccaggctggagtgcagtggtgcatcttggctcactgcaagctctgactcctgggttcgtgccattctcctgcctcagcctcccgagtagctgggactacaggcgcccgccaccacgcctggctaattttttctatttttagtagagacggggcttcaccatgttggccaggatggtctcgatctcctgacctcgtgatctgctcgcctcggcctcccaacgtgctgggattacaggcgtgagccaccgcacctggccccaatttttttttttcttaaccgtgtctttatggaaaagaggaaaacgttatggccatcttgtacaaatttctaggaacaaattttaaacttaacatttggccagatgcagtggctcatgcccgtaatcccagcactttgggaggccaaggcgggtggatcatgaagtcaggagttcaagaccagcatggtgaaaccccgtctctactaaaaatacaaaataaattagttgggtgtggtggcacatgcctataatcccagctacccctgagtctgaggcaagagaattgcttaaacctgggaggtggaggttgcagtgagccaacatcacgacgccattgtactccagcctgggcgacagagcaaagctctgtcttggaagaaaaaaaaaacaaagtttcaacttaacatttaaaagatattctgggcctggtgtggtggctcacacctggaatcccagcattttgggaggccaagcctggtggatcacctgaggtcagcagtttgagaccagcctggccaacatggtgaaaccctgtctctactaaaagtacaaaaatcagtcagacatggtggtgtgcgcctgtagtccaagctacttgggaggctgaggcaggagaatcgtttgaacctgggaggcagaggttgcagtgagctgagattgtgccactacacttcagcctgggtgacagagcaagactttgtctcaaaaaaaaaaaaaaagataatccagctgggcatggtgactcatgcctgtaatcccagcactttgggagggtgaggtgggaggattgattgagtcaaggatttcaagaccagcctggacaatataatgagaccctgtctcaaaaaaaaaaaaaaaattctgggcatggtggtacatgcctgaagtcccagctacttgggaggctgaggcaggaggactgcttgagcctaggagtttgaggttgcagtgagctgcaattgtgctgatagccgcaggtggcagtcaaatgcctaggcagatagggacagttccctggtgaaacctgactgtcaaaccaaggacagtttgtttgtttgtttatttattttttgagacggagttttgctcttgtcgcctaggctggagtgcagtggcgcgatctcagctcactgcaacctccgcctcctgagttcaagcgattcttctgcttcagcctcccaagtagctgggactacaggcaggtgccaccacacccagctaatttttgtatttctagtagagatggggtttcattatgttggccaggctggtctcaaactcgtgacctcaggtgatctgcccgcctccgcctcccaaagtgctgggattataggcatgagccactgtgcctggcctccaaagacagtttaaagcctgaaagccaagctacaagtcctgggtaaatccacggactggattgagaacctctcttccagttcggcaaggtttcctctgattgatccccacccttcacctgttttacatgtatttactcttccctgattggttttttacactgtcatgcccacctttgagtgacgcctttgttttagcctttttgttatatgcacaaaccaatcagcatacattccccattctgaacccataaaagccctgccacactgagagggagactacctgtcttcaagtgggagagtaccctcatgtgggtgctcttatgagcctcattttagcagtaagaaaaaggagtctcagagagatgaagttatttgcccaaggtcacacagtggtaggactagggtttgaatcaaagtagactgagttcatagcatttttgtaataaccaaatttctccagagtgtctgaatgttcctgactcctaaatcaaaaaacaaaacaaaacaaaacactggaaaatgcattctgattatgttcacctgatttcctaatctagagtactggacatttaattgtttggtaaaatctttgactttgaatgctttgccaaaaacaatggagcgtttgttttattatctctagactgaaagtggttatgttttcaccctggtaagtgatttgcttacattatagtagatagtattgctgcaaggtacaaccatattttttgtgtgtgtctgtgtctctctgtgtgtgtatgtgtgtattttcagtccattgaaatgaaatgtgtgggaattaggttccactttttttttattttcatttttttgagacagagtcttgctctgtcgccaggctggagtgcagtggcgtgatctcggctcactgcaacctccgcctccagggttcaagcgattctcctgcctcagcctcccgagtagctgggactacaggtgtgcgtcaccacgcccagctaatttttgtatttttagtagacatggggtttcactatgttggccaagatgatcttgatctcttgacctcatgatctgtccacctcggcctcccaaagtgctcacattacaggcgtgagccaccacgttgggctagggcccactttttaattgcttatgtccttgtgacttcttgcctctgaatccttgaattatttgttcttatttttgggccctaaagaaactaagtcccagcttttttttttttttgagatggagttttgcttttgttgcctaggctggagtgcaatggcacaatctcggctcactgcaacctctgcctccctggtacaagcgattcttctgtctcagtctcccaagcagctcggattacatgcatgcgccaccacgctcagctaattttttttgtatttagtagggacagggtttcaccatgttaggctggttgagaactcctggcctcaggtgatccacctgccttggcctcccaaagtgctgggattataggcatgtgccactgtgcccggcccagtccctgctttttatttatttatttatttttattttttaatttttttgagacggagtctcgctctgtctcccaggctggagtgcagtggctcgatctctgctcactgcaagctctgcctcccgggttcccaccattctcctgcctcagcctcccgagtagctgggactacaggcacccgccaccacgcccggctaatttttttgtatttttttaatagagacggggtttcaccgtgttagccaggatggtctcgatctcctgacctcgtgatccacccgcctcagcctcccaaagtgctgggattacaggcatgagccacagcgcccggcccctgctttttattaagaaaattttctaacataatgaaaagttgagaggacattataccttccacctgtattcactaattgttaacccatttgttttatatacttatttaatttagcaataattttataatatctaatatccagagatattcagatgttcttgttgttccaaaaatgtcccttatagtatttttccagacaggatccacattacttttttatttttatgtctctttagttgctttgattccatgataatctttcttcttcccgggaggcagagcttgcagtgagcagagatcgagccactgcactccagcctgggagacagagcgagactccgtctcaaaaaaataaaaaaatttttccccttcacaacattatttgtttaatttttaagagttccgaacagttgttttttagaatgtcccacattctggtttagtcacattgttttatcatggtgagtttaacttgtttcttgtattctcttctatttcccgtaaactggaaatgaggtctagacttcagattaaacattttttttgcagagtgtttcagtggtaatgccgtgtgtttcatattgcatcacatcgggggacacataaagctaggtcgtcccactgttccgtgtatcacttggataaggtaatgacttccatctctcaccattataaaggtgtatttttccttgtgcaagtagtagataatctgtggggatactctggtacgtgtcaatatcctattatccccccacatcatttacctaatgatttagcatccattgataatccctgcctgaatcagttattactctggagatggaaaaatggtaatattctagttttgtcattctgttatattaggtgatgttcttctgtacgaacagctttcatttttattattattatttttgatacagagtctccctctgtcgcccaggctggagcacagtggtgcgatcttggctcactgcaagctctgcctctcaggttcacgccattctcctgcctcggcctcccgagagctgggactacaggcgcccgccaccacgcccggctaattttttttgtattttttagtagagactgggtttcaccctgttagccaggatggtctcgatctcctggcctcgtgatctgcccatctcggcctcccaaagtgctgggattacaggcgcggtgagccaccgcgcccggcccatttttattcttttaaagtgcacttaggaataagattattgagtgtggtggtgtagtcaattccattcattattattaattttgtgctaaaattatcccaaatttgtccagtgggatgctgtttaaactagctcctttgttcttttgacaattcctgttagtcccttagcattttcttgttttctggcactactagaaaccccaaacttactttctacttttcttatcccagaccctggacgcagctggttctccaaggcttggtttctttaattaggaaagggtatttagaaattgacctctgagctgggcacggtggctcacgcctgtaatcccagcactttgggaggcctaggcaggtggatcagaaggtcaggagttccagacaagcctggtcaacatagtgaaaccctgtctctacgaaaaatacaaaaattagccaggcgtggtggcacgcacttgtagtctcagctactcaggaggctgaggcaggagaattgtttgagcctgggaggtggaggttgcagtgagccgagatagcgccattgcactccagcctgtgtgtgagccaagatcacaccattgcactccagcctgtgtgtgagccaagatcacaccattgcactccagcctgggtgacagagtgagactccgtctcagaaaaaaaaaaaaaaaaaaaaaaaaggaaattgacctctgaggttgaggctgcagttagctatgatcacaccactgcttgggtgataagaataagactctatctctaaataaaataaataaataaataaataaaataaaacattggtttttaaaaaaagaaatttagctctgggcactgggtgtgtttattgctgctaggatgtcattgtcttaaacaactttttagtagatgggggtaagaaatctattttttgaaaaaatgtgagttcactttgatacttccaatttatttatttatttttttgagatagtcttggtctgtctcccaggctggagtgcagtggtacgatctcggctcactgcaacctctgcctccctagttcaagcaattctcctgcctcagcctcccaagtagctgggactacaggcgcatgccaccatgcctggctaattttgtatttttagtagagatggggtttcaccctcttggccaggctggtctcgaactcctgacctcaagtgatccgcctgccttggcctctcacggtgctgggattacaggcgtgaaccgctgcgcccggcctataatattaaatttaagttggaaatatcaggcctgggtaacagagtaagacactgtctcaaaaataaataaataggccgggcgcggtggctcacgcctgtaatcccagcactttgggaggccgaggcaggtggatcacgaggtcaggagatcgagaccatcccggctaaaacggtgaaaccccgtctctactaaaaatacaaaaaattagccaggcgtagtggcgggtgcctgtagtcccagctacttgggaggctgaggcaggagaatggcgtgaacccgggaggcggagcttgcaatgagccgagatcccgccactgcactccagcctgggcgacagagcgagactccgtctcaaaaaaaaaaaaaaaaaataaaataaataaataaataaataggccatgcatagtagctcaagcctgtattcccagcactttgggaggctaaggtgggcggatcacctgaggtcaggagtttgagaccaaactggccaacatgatgaaaccccgtctctactaaaaatacaaaaattagccgggtgtggtggcaggtgcctgtaattccagctactcgggaggttgaggcaggaaaattgcttgagccaaaggaggcagaggttgcagtgagctgagattgcgacactggactccatcctgggtgacagagggagactctgtcccccgaaaaattataaataaataagtaaataaatagatgaaacaaaaagaactaacatagaatatgcatggtgtaactatgctaaatgaaactcaaaatatggccagacacggtgactcatgcttgtaatctgggcactttgagaggctgaggtgggcagatcacttgaggtcaggagttggagaccagcctggccattatgacgaatccatgtctctacttaaaatacaaaaaattagctggacattgtggcatgtgcctgtaattcttttattcttttttttttgaggcagagtcttgctgtgtgtctcccaggctggagtgtagcgcgagtgatctcagctcactgcaacctccacctccctggttcaggtgattctcctgcctcagtctcctgagtagctgggactacaggcgcatgccaccatgcctggctaattttttgtatttttagtagaggcagggtttcactgtgttagccaggatggtctcggtctcctgacctcgtgttccacccgcctcagcctcccaaagtgctgggattacaggcgtcagccaccgcgcctggcatgcctgtaattccagctacttgggaggcctaggtaagaggatcacctgagcccagaaggcagaagttgtagtgagccaagattgcagttgagactctgtctcaaaaaaacaaacaaacaagcaaaatcgttttggaaatacatatatattccccctccagctttattgagatataattgacaaaaggcatttatatatttgtttatttttgagatggagacccgctcagtcccccagactagactgcaggggctggatctcagctcacagcaacctccatctccggggttcaagtgattctcctgcctcagtctcctgagtagctggaactacaggcacgcgccaccatgcccagccgatttttgtatttttagtggaggtggggttttaccacgttggccaggatggtctcgatctcttgacctcgtgatccacttacctcagcctcccaaagttctgggattacaggcgtgagccactgcacccggcccgaaaatctttgttcctaatcatactttaacctacttgccttattctgtgttatatgtgaaatagttttaaagttacaatatcaatattactattaacaagtatactgagtgaattttaaggattttttgacatttgaaaaatgtatatcttactcaggacaaattatatttgatttatgtcataaactttttttaagttttttttttttttgagacggaattttgctgttgtcatccaggctggagtgcaatggcgcaatctccggtcactgcaacctctgcctccggggttcaagcgattctccagcctcagcctcccatgtagctgggaatacaggtgcctgccaccacacccagctaattttattttgtaattttagtagagttcgggtttcactgtgttggccagactggtcttgaactcctgaccttatgattcgcccgcctcagcctccgaaagtgctggaattataggcgtgagccactgcgcccggccgatttatgtcataaacttaatccaaaattaaatgagttttttttttttcttcttctttgagatggagtcttgctctgttgcccaggctcgagtgcagtggtgcaatttcggcttactgcaacctctgcctcctgggttctagcgattctcttgcctcagcctcgtgagtagtgggattacaggcgtgcaccactacgcctggctaattttttgtatttttagtagagacatggtttcaccatgttggtcaggctggtctcgaactcctgatctcatgatccaccctccttgtcctcccaaagtgctgggattacagacgtgagccactgcgcctggccataagtgttgttgttgtttttttttaatctgttatgtgaactaacagttctttcttttttttttaaatactcctacagtctaattttatttccgcatttatttatttatttatttgagacagagtctcattctgtcacccaggctggagtgcaatggcgtgatctcagctcactgcaatctccgcctcctgggttcaagagattctcttgcctcagcctcccaaataggagggattacgggcccctgccacggcgcccagctaatttttgtatttttagtaaagatggggtttcactaggttggccaggctagtcttgatctcccgacctcaggtgatccacctgcctcggcctcccaaagtgctgggattacaggcgtgagccaccacgccagacctatttctgcatttaaattatttttggggccaggcatggtgtcccacacctgcaatcccagcactttgggaggccaaggtgggcatattgctttgagctcaggagttcaacgacagctgggggcaacatggcaaaaacctgtttctacaaaaaataaaaaagttagctgggtgttggtagctcctggctgtagtcccagctactcaggagacaggctagagaatcctttgagcccgggaagcggaggttgcagtgagcccagatcgtgccactgcattccatcctgggtgacagagtgataccctgtctcaaaaaaatttaaaaaataaaattattttttggccaggtgttgtggcttatgcctgtgatcctagcatgtttagaggctgaagtaggcagatcacttgagcccaggagttcaagacaagcctgggcaacatgacaaaaccccatctctacaaaaaaatataaaaattatatttttataattaaagtataaatttaattataattaaattacaggcatggtggctcacacctgtaatcccagcactttaggaggcctaggtgggcagattacttgagttcaggagttcgagaccagcctggccaacatggtgaaactccgtctctactaaaagtacaaaaaaaattaggcgcatgcctgtaatcctagctactcaggaggctgaggtgggaggcttgcttgaacccaggaggtggaggttgtagtgagccgaaattgcgacactgcacttcagcctgggtgacagagcaagactccgtctcaaaaaacaaaacaaaacaaaacaaaacaaaaaattagctgaggtggaaggattgcttgagcctgagaggttgaggctgcagtgagccatgatcctcctacttcagcctcctgagtagctgggactacaggcatgtgccgccacccttggctaagttttgtattttttgtagaggtggggtttgccatgttgcccaggctggtcttaaacttctgggctcaagcagtgcacccacctcatcctcccaaagtgctgggattacaggtgcctggcctagcatttttgagacagagttttgctctgtcaccaaggctggagtgcagtggtgtgatcataactgtagcctggtactcttgggctcaagtgatcctcccacctcagcctcctgagtaggctgggactataggtgcatgccactgcacctggctcatttttgtatttgttatagagactgagtctcgctgtgttgcttaggctggtctcaaactccagggctcaagtgatcttcctaccttggcctcccaaagtgttgggattacaggcatgagccactgcacctggcctatattctaatttttaatctaccactttggggtgaactttcagcatgtccattttcttctctgtagaaggggtaatcctgccttccctgtttttgttttgttttgttttgttttgagacagtcttgctctgctgcccaggctggagagcagtggccctatctcggttcactgcagcctccatctcctgggttccagcgattctcctgcttcagcctcctgtgtagctgggattacaggcatgcaccaccacacccagctaatttttgtatttttagtagagacatggtttcaccatgttgaacagcctggtctcgaactcctgacctcaggtgatctgcccgcctcagcctcccaaagtgctgggattacaggcgtgaaccactgtgcccagccctgccttccctatttgcttcctgcgttttatagatgaactaaaatctgagaggctgcagtttcctagtagtgatacttggtggatagaatagaatctgcttgctctgctgccttcgccttcttcctgtcatctgtcaggagtgtgccatctgttccaagaagtaggctggccttccctgttcttgctccaaacacaacgaaaaagctccttctgttgctttcctgacactctggtacctttccactactgtgtttctatttaagttgatcatagttcgcttccatttcttgtacagaagatttaaaaatctgagtttcataatgtccttagatcatttttggtttctttttcattagggttatttgtactgatctcatctgagtttctggttcatacctctttactccttacaccatctgtgtgtgtgtgtgtgtgtgtgtgtgtgtttttaagcaatcttttctgagctttccacaaacatgtattgaatgctgtgagtcaggtggtacactaggtgctatgaaatgaaggaaaataagtacttcaagatgttcagagacgagtcaagtatttggctttggtttttagtattgatagccaagggtcgttaatcatgtattctaatgcttatgtctttgctagtgactcacatttattgagtgatttactctgtgccaggcacaaatctaaaggctttatatgttatacctcctttaatcctttagatgctatgaagggggtacttttattctactttatatatgaggaaatagaagcagaaagcagttaagttttccagtgctatgtagctgtaaatggtgaatttaggatttgagtctagctagttggcttctgagcatggtcgggtgtggctttgatccccacgcatgtgttcagtacctagaataaagtccctgaaattaaatatattatgaggagatatttactctgtacaaagttcatttacaaaaacccctaggggagaatagttaatttcatatgtgggaatttcagaaggcttcagaaagatgacttttgatgccaagtcattcattcaatgctagatgctggagaaatagtggtgattaggacagacatagtccctgatctttagaagctgacattccagtggaggtggatagaacagaaaccagcagactgatatatatagataatgttaggtggtgataaatgctagaaagtggaataagtactttttttttttttttttttgtgagatggagtctcactctgccacccaggctggagtgcagtggcatgatcttggctcactgcaagctccgcctcccaggttcacaccattctcctgcctcagcctcccaagtagctgggactacaggtgcctgccaccatgcccggctaattttttgtattttttagtagagatggggtttcactgtgttagccaggttagtctcgatctcctgacctcgtgatctgcctgcctcagcctcccaaagtgttgggattactggtgtgagccatcacacctggccagaataagtactttcaagtgggtagagtgcctctatgtgtgtatgtgttttgctttttttatatagagggtgaacagaggagatctctctgacagacatttaaatagagtcctaaagtaagtgagggagtgagtcatgttagtatccagaggagagagggttgcagacagaggcagccaaggcagaagccctggcgtaggagcaagcagggcattcaagcaataataggtaggaacatgtggctgggagggtagagagtgagaggccagaggtaggaggtgagcccagaaaggtcagcaggggccagatcggccataataaggagtttggactttattctaaatgtgatagtaagtcattgaaaggtcttaaacagggaatcaatgttatctgatttcaagtattaaaagtggctgtgggccaggtgcagtggctcgcacctgtaatcccagcagtttgggaggccgaggtgggtggatcatttgaggccaggagtttgagaccagcctggctgacatgtactaaaaatacaaaaaattagcctggagtgttggtgggcgcctgtaatcccagttactcaggaagctgaggcaggagaattgcttgaacccgggaggtggaggatgcagtgagctgagattgtgccactgcattccagtctaggcaacaagagcgaaactctgtcaaaaaaaaaaaaggggctgtgagcctaggcaatatagcaaaacgctgtctctaccaaaaatacaaaaaaaaaaaaaaaagccaggcatggtggtgtgtacccgtggtcccagctacttgggaggttgaagtgggagaatcacttgaacctgaggggcagaggttgcagtgagctgagatggtgccacttcactccatcccaggtgacagagccagaccctgtctcaaaaaaataaagttgctgtggttattgtgtgtagaatatgctgtaggcagccatgggcagaaacaagaagagcaaggatcttttgtattagtccatgtgaaagatgatagttgtttgaactaaaaagcagtgggggagttgatgagaagtgatcagcgtctgtataatttttgaaggtacagctgacagatttgctgacgacatgtaagagatagagaagagtcaaggatgactccaagggctttttctctcggtaccagtagatggaattaccacatgctgaaatggggtagacttcagtagaactaggttctagggagatgataagcagtttggttttgggcatgttaaatatatgagattcctttgagatgactaagtggagatgttgaatggatagttgaataacagagtcagatgttcaagtgtgagccctgggttagagatagacatctgggagttgggctgagtgcggtggctcacgcctgtaatcccaggactttgggaggccaagacggaagatcgcttgaatcccaagatcgagaccaacctgtgcaacatagtgagactctgtcttacaacacatatatacacaaaaaccccaagaaacctagctgggcatggtggtgtgagcttgtggtcccagctactggggaggctgaggtaggaggatcacttgagctagggaggtcaaggctgcagtgagctatgattgtgctgctatactgtatgattgtgcttgggtaacagagcaagaccctgtttcaaaaaaaaaaagaaaaaaagtaaaggaatttgggagttggtaatgagtaaatgggattaaaaaaatagactatattttagagcagttttaggttcacagcaaaattgagcagaaagtacagagttctggctgggcacagtggtttatgcctgtaatcccagcactttgggaggctgaggtggaaggattgcttgagcccaggagtttgagaccagcctggacaccattgcaagaccctgtctctacaaaaaataaaacaaattagctggggtagggggtggcttgcacctgtagtcctagctacttgggaggctgaggtgggaggatcgcatgagcccaggagtttgaggctacagtgagccatgattatgccactgcatggcagcttgggtcacagggtcacagagcaagaccctgcttctaaaaaaaaaaaaaaaaaaaaaaaaaaagaatgtatcaagttcccatattcctgtgttctccctccagcctcccccactttcaacatcctgcaccagagtggtacatttattacagttgatgaaccaatattgacacctcagtaccacccaaggaccatagtttgcattaaggtttgctgctggtgttgtattgtttatggattttgacaaatgtataatgtatatgtgtatgttacacatttatcaaaatccatatgtgtacattatacatttgtcaaaatccataaaagttacaaaagtacaaaaaaagtacaatattcataaaaagacaacttgatgctcaaaaagtttcggattttggatgtttggatttgagatgctcaacccatagtaaaattcgctctttttcagaatacagttgagttttgccaaatttgacagttcacgcaagccccaccacaatcaagatatgggccgggaatggtgactcatgcctataatcccagcaccttgggaggacaacgtgggaggattgcttgagcccaggagttcaagacaagcctaagcaacataatgggacttcgtctctcaaaaaaaaaaaaaaaaaaccataataaaagtaataataatagctgggtgtggtggtgtgtgtctatagttttagctactcaggaggctggggtgggaggaagactgcttgagcccaggaggtcaaggctgcagcaagctgtgattgtaccgctgcactccaactccagcctgtgtgatagagcgagaccctgtctcaaaaaaaaaaaaaaaaaaaaaaggggtgaagaaagaaaaaaaaagatataaagcacttctgttacccacagaatttcctcatgtccatttgtaatcagcctctcctggcacctccagctcctgtcacccactgatctgtcctttgtctatacagttttgccttttccatagtgtgttataatggaattattcagtacatagccttttggatttggcttcttaaacttagcgtaatgcatttgagactcacccgtatttttgcatgagcaaaataaagggttgttgcttttagaaccaagtagtaagtattccattggatggatataccacagcttatctgtttatgtgttcaaagacatatggattgtttccagttttgggttaatatgaataaacatttatatataggtttttatgagaatataagttatcatttctcttggataaataccagcgagctggattgctgggtcatgtaagtgtatgtttaaccaggtgagaaaccgccaaactttttcagagtctctgtaccattttgcatttccaccaggaatgtcaggaatgtatgagaattccagttgctctgcattgttgtcagcacttggtgggattcttttttttctctcctttttttttaattaactgttttaaaaaattgagatatagtttacatgttataaaattcatccttttaggctgggtgtggtggctcacgcctgtaatccaagcactttgggaggctgaggtgggcggatcacaaggtcaagagatcgagatcatcctggccaacatggtgaaaccctgtctctactaaaaatacaaaaattagctgggtgtggtggcatgtgcctgtagtcccagctactcgggaggctgaggcagtagaatcgcttgaacccgggaggcagaggtttcagtgagccaagatcacgccattgcactccagcctggtgacagagtgagactctgtctcaaaaaaaaaaaaaaatttaccatttcaaagcatacaattcaataattcaatggttttcagtgtatttacaaagttgtacaattgtcaccactatctaattccagaattctcattatcccaaaaagaaacctcatacacattagcagtcagaccctatttcctccctgcccttcccagcctaggcaaacacgaatttactttccctctatatatatgcctgttctggacatttcatagatatggagtcatacagtaggtgactagctgctttcacttagcatgctattttcaaggttcatctatgttgtacgttactgctttttgtggatgaataattccattatatgagtataccatattttgttttcccattcatcagttgttgggtatttacagtgtttcttctttttgggtattgtgagtacacatttgtgtggacatatgattttacatcatatgggtatatacctaagatggaattgtcagatcatatggtaattctgtttaaccttttgaggaactgctaaattgcttttcgtagtagctgcaccattttacactcccaccagcaatgggaatcctgtttgtttttattttgaagagatgggagtcttggtattggcccagactggactcaaactcctgggctcaagtgattgtcctgcctcaggcctcctgggtagttgggactgcaggtgcataccaccgtgcccagctattttttacattcaataagaagtaaaattatcagctgagactgagatcaggacagggagggcttaggtttgaggaaagaagataaggtatgaaatatttaggagtttgcactccctcctcaggctccactttactcagtagctaatgacaggcctcaaactcctggcctcaagttatcctcctgcctcggcctcccaaagcactggggttacaggtgtaagctaccatgcctggctaaaaacttttttgatattaattttcctggctccttaaaggtataagacattgaattaagaagagtgcaaaattgctactctataattaggttaattatttttagagagagggtcttgctttgttgcccaggctggagtacaatggctatttacgagtgccatgaaatacactacagccttcaattctttggctcaagcagctctcttgcctcagcctcctgtgtagttgggattataggcatgcactatagcacccagctcttacacttttattttaaaaatactttttgttgagttttaatttatagtagagtgtataaaccctaaatgtgtagcttgatgaacttttacatatgtatacacttctatagccaccacccaaatcaagatatggaccattatgggcactccggaagcttttttgtccctctcctacccccaaagagaattactgtttaatacctgtttgcagatatgcattttatatatgtatgtatgtgtgtttgagacagtttcgctcttgtcccccaggctggatggcagtggcacgttctcggcttactgcaacctccgcctcctgggttcaagtgatctcctgcctcagcctcctgagtagctgggattacaggtgcccgccaccacactcgactaatttttgtattttcagtacagatggggtttcgccatgttggccaggccgggctcgaactcttgaccccaggtgatctgcccgcgtcggcctcccaaagtgctgggattacaggtgtgagccactgcacctggcctagacatgcatttaaagtgagacccatcagcatgttgagtgttttctctagccacatttagctgtctgggtacaggaatggagaatgtggagtctgaaataaccagggttgggtggcagttgtgatgaggaagagagtcgccagtaatttgagggcatatgcaaggaagtgaaattaaagaatgagaagatttccaggaagagagtggcagggggagaaggcagaaggaataacatcagcaaaaatattcagggcttgaaagaacttggtgtgttctgagaatccagggaggtaacaggagtggtgggagattgaactgaagagtgaaaatttaagcaggagagagacatgttttgatccttcttagtaacagaaaattggcagtgttcattctgtcataagatatttgctgagtggctctgtatcaggcattctgctgggtactgatagaaggggtttaggggtgatgtgtacatactgactgttcagttgttgctggtaagaaatgattgagatagagaggaaagataaatttaagacctttcttatatcagatgttgattaatggaagtggtgaaggggtagggaaagagttaaggcattcaaaatagcagtttttctgcagtttaatagtcagccttttgttttttactaaatatatcttccatccccatctcctctccagcaaaggctggtgatggcttagaatgttccttttgtgcatagaagtattttgcttctggtatgtgccctgagccaggaatagaggcaagctctgattttttttcgctcttgtcgcccaggctggagtgcaatggtacgattttggctcaccgcaacctctgcctcctgggttcaggtgattctcctgcctcagcctcccaagtagctgggattacaggcatgcgccaccacgtctgggtaattttctgattcttgaagtaaaatgagtgctgtatgtttgcagacaaactgtttatatagcaaagaatctggaagcagtctgaatgcttaacctctgggggaaagttaagtcaaattctgggctagccacgcagttaagtagactattacatggctaagacaaaagacacccatgtggatgtggtgactgcaggaatgtttacatgtggagtccagttaagagcagaaggctcatagccgggtgcggtggctcacgcctgtaatcccagcactttgggaggctgaggtgggtggatcatgaggtcaggagatcgagaccatcctggctaacacggtgaaaccctgtcactattaaaaatacaaaaaattggctgggcgtggtggcgggtgcctgtagtccagctactcgggaggctgaggcaggagaatggtgtgaacccgggaggcggagcttgcagtgagccaagatgacgccactgcgctccagcctgggcaacagagcgagactccatctcagaaaaaaaaaaaaaaaaaagcagaaggctcttcaccgggtttagagttagatgtagatatcgatcttgattgtgcctcttcctagtcattctctttgaggctccatttccatgaatgtaaaaagggggcagtaataataatgactccttaagtcttcatggcatgatcaagtgagataccttagataaagatagtttacaaaccctagagtaagctgcactcattagttttatttatttatttatttatttatttctgagacagagtttcgctcttgttgcccaggctggagtgcaatggcatgatctcggcccaccacaacctccgcctcctgggttcaagcaattctcctgcctcagcctcccgagtagctgggattacaggcatgtgccaccatgcccaggctaattttgtatttttagtagagacggagtttctccattttagtcaggctggtctcgaactccaggcttcaggtgatccgcccgccttggcttctcaaagtgctgggattataggtgtgagccaccgcgcccagcctcattaattactaatagccatgtgggtgaacactgatgagttgtagtgggaattcggaaggaaattgtcatcctttctgtttttttctccccggccccatgatgtttctttagttagtatttctggtatataggggggaacaaaacagattcctgccaagcactgtctggctgctctagtttaagcacgtgcacggtatgtagtattaggcagcttaattttacacagatgcagcaagactctgagcggcaagccttcctggggcttaaggtcatatagggcaggcatgtcaacactgtttccctgaattagacctgtactgttctctgccttctggctgtgcacatggagtcatgccagcagtggcagtgctttactgtcttacagccctctctctcccttggtggagccctaggacatgttggcttatcttgtagcttagagcagtgtttctcaaacctgaaaacatgaggactggcacctctaacctataaactattgatagactccatttctagataccaaagcagtctagcaaaatgcaactttgttagctacttagtgctgtgtaacacattttctcaaaatttagtgtcctaaaacaataaacatttattattctctaggtgtctatgggccaggaattcaggagcggcgtaatggggggttgagggggcttctggcccaggatctcataaaggctgcatccaagggggctcactcacagggctggcaagttggtgctggttcctgacaggtggcctcagttccttgtcatgtgaacctctccatagacatctagaatgttctcacgatgtagcacctgacttaccctagaacagggaatctgagagagtgcagggcagaagcagcagtgctttgtgtatatgcttgtggtaaaatacatacaacataaaatttagtattttaatcatttttaggtgtgcagtacagttctgtagcgttaaatacattcacactgttctgcaaccattaccagcctacttctccaaaatattttctttctttcttttttctttttttcttggtgatagattctcactctgttgccaggctggagtgcagtggtgcgatctcagctcactgcagcttctgcctcccggtgattctcatgcctcagcctcccgagtagctgggattataggcttgtgccaccacgcctggctaatttttgtatttttagtagagatgatgtttcaccatgttggccatggctggtctgaaactcctcacctttggtgatccacctgcctcagcctcccaaagtgctgggattacaggcatgagccactgagcctgacctaaaatttttcatagtgagataaaatctcactatgttgtttatgttggtctcaaactcctggccttagccgtgcgccatggctcatgcctataatcccagcactttgggaggctgaggcaggcatattgcatgagcccaggagtttgagaccagcctaggtaacgtggaaaccctgtctctcctggcctcaagcaatcttcctgccttggcctctcaaagtattgggattataggtgtgagccaccacgcccagcccaagattttttctttttctttttttttttgagatggagtttcgctctgtcacctaggctggagtgcagtggtgcgatctcagctcactgcaacgtctgcctcctgggttcaagcagttctgctgcctcagcctcccaagtagctggggctacaggcgcatgccgccatgcctggctaattttttgtattttagtagagacggggtttcaccatgttgcccaggctggtctcaaactcccgagttcaggcagtccacctgcctcggcctcccagagtgctgggattacaggtgtgagccaccgtgcccggcctgattttttcatctctccaaactgaaaccctgtatctattaatcagcaactgcctcatcccttctccccttagctcctggtaacctctattctgctttcattaatctggctactctagataactcagatgaatggaatcatgcagtatttgtccttcaagtggcttatttcacttagcataagtcctcaaggttcatctgtgttgtagcatgtattagagttttattcctttttaaggctgaataatattccattgtatggatataccacattttatctattcatgtattagacacttgggtggctttttgactactgggttgtcttttgactgttgtgagtaatgctgtgtgaattctggagtacagacatctgtttgagtccttgtgttcagtgtttttggatatatacccagaagtggaattgctgcagtgcttttttttctttttcacatcaactttatagttagataatccatcactttattaattcagaagtttgctttttttttcccttcaactttttttttttaagttctggggtacatgtgcaagatttgcaggtttgttgcataggtaaacttgtaccatggtagtttgctgcacagatcatcccatcacctagctattaagcccagcatccattagctcttcttcctgatattctctctcccctgtcctgctgcagtgctttttataacccagctttggaagtcccacaccatcacttttgccacattctacttgttagaaatgaggccatattcaaggataaaacgattaaaatctaccttttgaaggaataagtgccaaatctgcagacatataaagttgtcccagctactatgtgggagtgattttataatgccaggttagttacaaatatacacactaaagttatttctttcttccttccctccctccctctcttcctccctccctccctcctttccttctcatttatttattttgggtctcactctatcacccagggtggagttcagtagtgcgatcatgactcaacacagcctcaaccttctgggctccagtgatcctctcacctcagcctcttgagtaactgggactacaggcatgcatcaccacatctggctaattaaaaaaatttttttttgtacagacagatggggtctccctatgtttcccatactgatctcaaactcctgggctcaggggatcctccttcagccacccaaagtgctgggattataggcatgagccattgtgctgggctgattaaatttttttagaaatagggtctcactttcttgcccaggctggagtgcagtggtgttgtgatcatagctcactgcagcctcaaactcttgggctcaagtgatcccccaactccaacctcttaagtagctaggactacaggcctggctaatttttaaaactttttgtagagacggagtcttcctatgctgcccaggctggtcttgaactcctggcctcctgccttggcctctgaaagcactgggattacaggtatgggccactgcgcccagccttacacactaaaattttctagtagttcttgattatatggtggtcatctggtatctcaacgttcttcatgtcattgcccacttgtaacccatttgtggtacctcagctgggaagctctggtaaagagggtccagattacagaaaagcacaatataatattcttcatccctcatggagaccttgtggaccagcagctctgtgttcaccaacacgcagtggtccgtggactgctcttggcaaacattcatttagggctcagcagcccatccataagatcctcctggcccctcaaacggagttgttgtttcctctatccccttgaatttccttgtcctcttttttgcctgctttcctctgtactatgctgatttactcctattacatcttctctcagaaactctccccagcttcactgcctctttgatcagctggaaaatgcctactcatctttcagaatggagatcaagtgtctcctcttccccagggttgtcttgggccctcctctcactcgatccccttcctctccctctccccttttgcacctctgtatcttactctaccttaaggagtcctctgttgttgcacctggtatactttattacaattatttgtacctatagacatacttagatacttttattcccccagactatactgtagtaagtaagagacagatgcctctagcagtgcctgttgtctcctggggaagcaggccataaacacaaacaaatgaaataatgacagattagggtaaatgctatgaaggaaacatataggaaactgacacagactggaaagaaatgggggctacttgagatagtgtagtcagagattctgaggctatgggaggataaggatgttgcctgggaagagtgggcagggattgttgtttcaggtaacgggagcatactcggtatgggaaggtgtgtggtgtgtttgaggaattgaaagtctactgtgtgttgtaacgtagggcctgtcatcctctgccagttgctgtgatcatgcatcttaatagatttggttctggccagatgtggtggctcacgcctgtattcccagcactttgggaggccaaggcaggtggatcacgaggtcaggagttcgagaccagcctggccaacatagtgaaaccctgtctctactaaaaatacaaaaaatgttagctgggcgtggtggtgggcacctgtagtcccagctacttgggaggttgaggcaggagaaacacttgaacctgggaggtggaggctgtagtgagctgagatcacaccactgtactccagcctgggtgacagagtgagactccatctcaaaaaaaaaaaaaaaaaaaaagtagatttgattctgtatttctaaaccctaatatacttcctggcccagagcaggtactcagaaaatgtttgtggaattatggttcaatgaatttttcttctgctgatttctgttcattctccttgtccttttccatttgacattggctatactggtcttctgtggcttcttggttggcttagtgaccagttatctgacttgcttaaattaagcttattacggtaaccttatttattatgaatttttgcttatctgtcctttccaggttgaattttagatgagagtttttgatgctttttggcctttggaaaacagttttgtgactaattttgtcatggtgaccaccatgtgcatatatcccctccaaattaagagttcccatactggggtatgtttgtcctcttgacatctacaacatgaatatcactggtttattttgatgattcatcttggtttgtttatatatttctattgctgttttgtggctccagatctttttaaaaattacatctggtgaacctttattgaatgtctaatatatgcaggataccctgggggagattcagactcttgatctctgaaggtttgatccaaaggctaagtcttctctgaaccctttcccaaccctctagttagaaaaaatgggactctgatgaaaaagtttaatgtgggctttagaatgaagggttaaaaaaaataaaaaatagaccaggcacagcggttcatgcctgtaatcccagcactttgggaggctgaggcgggcagatcacgaagtcaggagttcaagaccagcctggccaacatggtgaaaccccgtctctactaaaaatacaaaaattggccaggcatggtggcgcacacctgtaatcccagctactctggaggctgaggcaggggaattgcttgaacccgggagacagaggttgcagtgagccgagatcatgccactgtactccagcctgggcgacagagtgagattccgtctcaaaaataaataaataaataaataaataaaaaggcgggagggtttattcaagtgctttagaagggggcagggaagagcagcagaaacccagactgtccagcctgggctggacatggaggagagataatgcctctcttctgtctagtcctggttatgggatataggcaggctggttcattctacagctatggttttttttttttttttttttttgagacggagtttcgctcttgtttcccagtctggagtgcagtggtgcgatctcggctcaccacaacctccacctcccagataaagcaattctcctgcctcagcctctcgagtagctgggattataggcatgcgccagcacacccagctaattttgtatttttagtagagacggggtttctccatgttggtcagactggtctcgaactcccaaccgtgggtgatccgcccgcctcagcctcccaaagtgctgggattacaggtgtgagccactgcgcccagccagctatgcttctttttctctcctttcttcctgagatccagagtgttcctgatctttttgcttgtggagaggagtgggaaatctcatggagctcaccaaacttctctttgggctcttgccaccctaggggctctgatgattggtcatctattctgtgtctccaggacctagcagtttgtttgtctcataatacaaactcaggaatgtttgttgaataatgaagttcatagggcatagttcctgccctgtaaagtgcttagcagccttgtgtttatattagccatttaaaaatcttgtttgtgacttgagtttgaaacatttttgttgactcttgaactctttcttctgaggaaaactattgatttttgaacatttaagttgtacctgattatcatttcaaactctcttatcagtttaggaaaaattgactcaagaagaggtaggaggccgggtgtggtggctcatgcctgtaatcccagcactttgggaggctgaggcgggcggatcacgaggtcaagagattgagaccatcctggccaacatgctgaaaccccgtctctattaaaaatataaaaattagctgggtgtggtggcgggcgcctgtagtcctagctactcaggaggctgaggcaggagaatcgcttaaacctgggagtcagaggttgcagtgagctgagaacacgccactgcactccagtctgggcgacagagcgagatgccatctcaaaaaaaaagaagaggtaggaaacttgatcagactagtaaccatagaagtgatgggaaaggtagataaagaactaccttctgagaaggccctcagagtaggtggtttcatagaaaatgaaataaagcattttagtttgttgtatgagattatcatagcctaatactgaaactgggcaggaagggcataatacaagaacacttggacagatctcatttataagaggtacaattcttgtcaataaaatcctggaacaccaagtagagacttattaaatgaatgatgcatgaaaccaaatatgatttattctagcagagtaatgataacttaaatttaagaaatctatcagttcattatatttacagaataaaagagtccgggcacagtggctcacgcctataatcccagcactttgagaagctgaggtgggtagatcacttgaggtcaggagtttgagaccagcctggccaacatgatgaaacccgtctctactaaaaatacaaaaaattagccaggcgtggtggcgtgtacctgtagtcccagctactggggaggctgaggtgggagaatcacttgaacccgggaggcagaggttgcagtgagccaagatcacaccactgcactccagcctgggcaacagcatgagacttcatctcaaaaaaacaaataaaataagataaaataaaagagaaaacttttataatcttcttgacaaaggctgaaaattctaaaaatttattattacctgttttttagatgggggtctcactctgtccccagagtagagtgcagtggcacaattatagttcactgcagctttgaactctttggctcaagtgatcttcctgcctcagtcttctgagtagctgggacaacaggcacacaccactactcatagcaaattttttttttaactttttttttttagagatggggtcttgctgtcttgttcaggctggtctcaaactcctggcttcaaagtgatactctcatcttggcctcccaaagtgctgggattatagacatgagccactatgcccagccaatattcttattttcctcttctataacacaaaaggtatcataagatatgcactattctgtagcttgttttttaaaaacttaatgtgtcatggaagtctttctgtatcagttcatagagtgtgtcttcattctttcttgtggctacataatatgccattttgtgggtgtgccatagcagcacataaacataatattcatgaagctatcggttgatatctttaaaaaagttttttaaacttttaatttgccgggcgcagtggctcacgcctgtaatcgcagcactttgggaggccgaggcgggcggatcacgaggtcaggagatcgagaccatcctggctaacacggtgaaaccccatttctactaaaaatacaaaaaattagccgggcaaggtggcaggtgcctgtagtcccagctactcgggaggctgaggcgggagaatggcgtgaacccccggcggggcagagcctgcagtgagccgagatcacaccactgcactccagcctgggtgacagggagactccgtctcaaaaaaaaaaaaaaaaacttttaatttaaaagtatttattttttggctgggtgcagtggctcacacctgtaatcctagcactttcagaggccaaggccagcgatcgcttgagcccaggaatttgagaccagcctgagcaacatggcaaaaccccgtttctacaaaaaataccaaaaaagtatcttagccgagcatggtggcgtgagcctgtagtcccagctactcaggaggctgaggtggatcacctgagcctggtaggttgaggctgcagtgagtggagattgcaccactgtaccccatcctgggtgacacagtaagaccctgtctcaaaaacaaaacaagaaacaaaaacaaaaacaaaaaaaacacaaaaccccaaaaagtacttattttttacttatacaagtaatatttaactaaatttttaaaaaaattcacactaaagcaaaaatctcttggttattcctaatccctatctcctcctaagagctaatttttgttattagtttgattatctgcccctttctggccagtattcccgctggttggaaatgtaactcccagctgcaatgttagtttggaaactagagtctcatcagtggctcttagttacacagggaagctagaaattctctcttccttttctgcctgtacaaattccattcacatctcttttgttaactctgtctcatcatcttcagcctgctttatggttgtccatatatttaggttgaaccagataaaattgctattttggtaggtaaaaagcagttgattatcagcaattaaatgtggttcaacctaatagttttaaagcctaatccatttatgtgtctagttctcctcaagggcaggggccagaacacatgtttgtataatcccttccaagacttagaattggctggtcagatcaaaagcacttaataaattcctgttgactgatgaagctaagctgtcgccaaggcaggcagagttgtgatccactaaatcttaccaggttgatctctaagatggtttttgcagcctccctcttctctgaaatgtaattgggtccccaccgccgtaagtgacttgcatctttgtcacactttagggaagtggggaggaccacttaatctttggaaaattttgcgccttggctactattgagcctcttggaggggtttgtttaggtctgcagagagttggatatgtgtgcccaataaagttttttttgaatgagggagaagctttacattagctgaggacgtaaagacccttcagagtgagtggagttgctggcctaggagttcacacttgattctatgaatcctgacttccgaccagtgcatatccaaaagaatttaaggttttccctgaggttgccaacttttaattttgccaaataaggacatttaaaataagtatgtaattatgtacttttaatagttaatatgtgctcatggtacagcattcaaaatgtccaaaaggatatacagcaaataaaatgagtctcatgcttcctctccagttgcttaaaactatccagttccccttccgggaggcaaaccgggttacttgatcctccttcccgaggtagcccacgcatttaaaaacaggtatgactgtactggctctctcccttcccccacataaatggtagtgcattcaaatactgtttgacatctttgagtttacctcccacatttcttagaaatcttttaaaatcaatacattaaaaaaataaagtaaaatcaatacatagagctgccttattctttttgaaggctgtgtgatattaggaagggtattaaaaacagttgttatcgttttaacttagaaggtatatttaaatactaaaagttagaaagaatgcgatttcaagcgggacgtggtggttcatgcctgtaatctcagcactttgggaggctgacgcaggaggatacttgagcccaggtgttcaagaccagcctgggcaacatagtgagactccacctctacaaaaaaaaaaacccaataaattagctgggcatggtggtatgagcctgtagtcccagctactctggtggctgacgtgggaggatcacttgaggtcaggagttcaaagctgtagtgtgccatggtggtgccactgcactccagcctgggaaacagagcgagaccctgtctcaaaaaaaaaaaaaaaaagtgatttccgtgtaaagaaaatttcctgccttagtccaaggaccctgtgtgagaaagctgttgctagagatagtaaaccattaaagaaagtggtttgaagccaggagcagtggctcacacctgtagtaccagcactttgggaggccgaggggggcggatcacgagatcaggagatcgagaccatcctggctaacatggtgaaacctcgtgtctactaaaaatacaaaaaaattagccgggcgtggtggcgggcgcctgtagtcccagctacttgggaggctgaggcaggagaatggcatgaacccaggaggcggagcttgcagtgagctaagatcgtgccactgcactccatcctgggtgacagaacgagattccatctcaaaaaaaaaaaaaaaaaaaaagaaagtggtttgaataggaatgtgttaagacagattgtgttattttagagaggtttactagcctcaggtaggctgaatgaatgagagggtaagagatatataattgccatattgatgtccttctccccattttacagagaggagtggatttagggaatcctctcttgtctcctacaattgtactatttcatttgtcagatcagacaattagccagtctgttgtcaagatatcttgtatttatagcagctgtcatttggattggagtaggaagactagtttcagggctgtttatgtcttttgttaatatttttgagcaagtaaggtatgcatagtagcaattaggaattatggaaaacatacccttccagtcctctgtgaggaatacacacatgaagtgatgggggcctgaacttgaggagtgaaattggaataggttgctggagtctgagaatgttggaatttaaaaactgacagaatacatgacctttgggaagaataagaggagtggaattcatttgctaaacatttattgagtacctagtatgtgcaaagtactgcaataagttaatgccaagcaaactgccttagagggtgctagtgtgggttgaaaagtacacagtatacagacacaagaaagcaggcctgttcatttaggtaggtagcatgtgtttattaggacagcactgtactaggtgctggatataagaaaggaaggaagtggtacaaaccaggttgcagggagaaaatacagatagaatgtaaactttttcagtctagaatagctatttgattaatacaagtgttttcagagaaaaactgcatacaatatttttctttatttttaaccgtttattttttggaatgagcaatacctttatatagttgaaataaaaaggtattataaggtatactgcaaaaagtctccctcctatttttgccccttcccacctcttatccagatacctctcttgtgtcaggaataaatgctggaaacagaaaccagcccgagtattttaaccacaaaaggatttaacgtggggaattgggtacttttaaagttgttggaagggctggaagagtgggactcaaggaggctgcccttagggtatcatcttgaaaggcccacaatcgtagctgtgatctggtcaggaagtcactactggcactgccatctgcaccactgctgcttgacatgcatgaaactgatgattagacattaggctctggcttattgcagaccagcagcagcagcagcagcagcaacatctgggagcttgtgagagctcttaggccccagcttggcatactgaatcagaatcttcatttcaacaggataccttgatgatttacatgtgtgtggaagcttgataggccttgtactggacctggccactaacccaagggtctttatgaccttggccaccaattgtaaggaagtcagggaaatgtagttgttgattttcctaactctcagtctagaaagaaggttgaatggaggttgaaagaaaccatctactgaactgaccacacttttccacaagtaacctttgttgtttcttgggcatccttccagatactttatgcatatataagcatatgtgaatacatatccttttttctcctctttaaaaagtaagtcaggtgtggtagctcatgcctgtaattccagcatttggggaggctgagccaggatctgctatcctgggcagatagcttgagcccaggagtttgagaccagcctgggcaacgtaacagaactccatctctacaaaaaatacaaaaattagcactgtatggtggtgtgtgcctgtagtctcaactacttgggaggctgaggctggagggacacgagctggggagagggaggttgcagtgagccgagatcacgccactgtacttcggcctgggtgacagagtgagaccctgtctcaatcaatcaatcaatcaatcaaaataaaacgaaacaatagcttagcatatacagtgttctgaatcatataactgtatatcttagaagagctttccatatcttgacagataaaatcatcttgttctttttaataaccgcgtagtataaggctgggcacggtggctcatgcctgtaatgctagcactttgggaggctgaggtgggcggatcatgaggtcaagagatcgagaccatcctggccaacatggtgaaatcccgtttctactaaaaatacaaaaattagctgggtgtggtggcacgtacctgtagtcccagatactcaggaagctgaggcaggagaatcacttgaatcagggaggtggaggttgcagagagctgagatcgcgccactgccctccagcatagcgacagagcgagaccctgtctcaaaaaaacaaacaaacaacaaccaaaaaaactgcacagtattccattatattgcttataaatgcttaaaattgagactgtctgatacagtctgggttgcatggtcattctgatttattggcacatgtaaaatctaatctagttgttaaatccttaatgttttcttcctgcctcttgtgtgctcaagtcttctgtgtatgtcatcttgtttaatccacactacaacccagtgtgcttcttccactttacatgagggaactcaggctctgaaagtttaatttaatggttcataaactggccgggcacagtggttcacccttgtaatctcagcactctgggaggttgaggcgggcagatcacctaaggtcgggagttcgagaccagcctggccaacatggcgaaaccccatctctactaaaaatacaaaaattagctgggcatggtggcgggcgctgtaatccccgctactcgggaggctgaggcagggagaattgcttgaacccaggaggttgcggtgagccaagatcacaccactgcactccagcctgggtgacagagcgagactctgtctcaaaaataaaataaaataaaatagttcataaactaaggaatatgcaggttaggatttggacctcaagtctgttaccctccataatttgtgatttgacccaactacacagagtctctaaacggtaggcctggtaaccttctcctttgggaagaggtttggaaatgtaccattatggatatttggatatttggggtgggtattaaaggaatgccaatttttttttttctgactcaggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgtgagtaacaaatctgggaagttctgtagtatgcaaggtcagccattgggctgtttgtgtttcaatctttgatgttagtagcagctggagaccagttcttatttaggcctatagttgtaaccctgagatctctatgacacctggggctcttgaagaatcccaattttgtttgtttgttttttgagacggagtctcgctgtgttgcccaggctggagtgcagtggtgcagtctctgctcactgcagtctccacctctcgggttcaagcgattctcgtgcctcagcctccctagtagctgggattacaggtgcccaccctggctaatttttgtatttttagtagagatggggttttgccatcttggccaggctggtctcaaactcctgaccaattttacggcattgtatccctaacttctagaacactgcctggcacattgtagatcttctgatcttttgttaagctgtctggtcttttgttaagtgatcattctggccaggcgtggtggctcacacctgtaatcccagcactttgggaggcggagacaggcaaatcacaagatcgggagtttgagaccagcctggccaacatggtgaaaccccacctctactaaaaatacaaaaaattagctggatatagtggcgggcgcctgtaataccagctactcgggaggctgaggcaggagaatcgcttgaacccaggaggcggaggttgcagtgagccaagatgatcatgccactccactccagcccgggtgacagagtgatattccatctcaaaaaaaaaaaaaaaaaaaaaagtgatcattccatgtagaacgttgtactaagtctcatatgcaaggtcttcttcttttgagacagggtcttgctctgttgcccagacgggaatgcagtggtgcaatcatggctcactgcagcctcaatctcccaggctcaagcgatctttccacttcaacttcccaagtagctgggaccacgggcccaccacacccggctaatttttaaatttttttatagagacagtgtctcgtattgttgcccaggctggtcttgaactccgggctcaagtgatcctcccgccttggtctcccacagtgctaggattataggtgtaagctcgtcctgcagagtcttttataagcccttaaagaacttggaattgattggactgtattccatttttctaaattttatctctatgcctggagcttttactgacttcaaaatgcagtatgaagtattagttttaaggtttttttgttttgttttgttttaagcagtgaaagcacagatttattgaaatgaaagtacactccacagagtgggagcgggctcaagcaagtagctcaagagccgtttttttggtttgtttttgagacggggtcttgctctgttgctcaggctggagtgcagtggctcgatctcacctcactgcaacctccatctcctgggttcaagcgattcccctgccttatcctcctgagtagctgggactacaggtgcgtgccaccacacctggctaattttttgtatttttagtacagatggggtttcactgtgttagccatgatggtctcgatttcctgacctcgtgatccgcctgcctcggcctctcaaagtcctggcattacaggtgtgagccaccgcgcccagccggttttttttttttggttttttttttttttgataatgttgtccagctttatttttgctttcttgccaaagatttgtcaagctcctcactctgtcattataaaattcccaccctgagaatctcccatttttcttcaccatcaccacacacacacacacacacacacacacacacacacacacacacacacaggctgaaacaataaaatataaagttcatcctaagaagaagatatcgagtccaaagagggttatcaactttagaaaagaagcaaagaaatcataaaataatgatattttaagattacagattaagccctaatttagaatatttttagaaattttatcatattaaaacaagggtgaaggcactatagactcttgttttttaactaactttatttaaattagctatacccattttaagtgtatgatttcataagttttgtgtaataagcttaaatttaataagcatttaaatttgtgatataaaaatcacccattttaaactgtatagtttaataagttttgcaaatttatattgtcagatagccactgccatatgatacacaatattttcattatgacaaaaagaagctctccctcaaattgcttttcattcagtcttcaccagccagtcctggaccagttctggaccctggcttgccactgatctatctattttctgtttatagtcctatttttgtttggtttttcatttgaaataaaatcatactgtatgtaacatttcgggtctgacttacttcaattagcatatcttttgaagcttcatttatggtgttttttttttctgttcctgtaataacagtttgttttatttttttaattttatttattaatttttttattatactttaagttctagggtacatgtgcacaatgtgcaggtttgttacatatgtatacgtgtgccatgttggtgtgctgcacccattaactcatctttttttgtttttttttaaagagacgttttcttgctctgtcgcccagtctgaagtgcagtggtgcagtcttggcttaatgtagccttgacctcttgggctcaagcaatcctccttcctcagcctcctgagtacctgggactataggcatgtaccactgtgcctgactaattaaaaaattttttttgtagagacaaggtcttattatgttgcccaggctggtcttgaactcctggccttaagggatctttctgccaaagaaggaagatccttcgtacctcccaaagtcctgggattataggcgtgtgcccttgtgcctggctagttttaaggtttttaaacaggcattgagacatctataatggtcctgctgcttttggatctgactcagactcagccctgccttctatttttctttctttttttttttttttttgaggcagtcttactgtatggccgaggctggagtgcagtggcatgatcttgactcactgcaacctgtctttcgggttcaagtgattctcgagtcttagctttctgagtagcttggactacagacgcatccaaccacacctggctaatgtttgtatttttagtagaggtgggagttcatcatgttggccagactcctggcctcaggtgatccaccttccccagcctcccaaagtgctgggattacaggcacgagccactgtgtccggcttattttctgttttaaccctattagggaacttgaactattgctggccttttttttctttttcccaattaaggattattcagtattgttccatttgacttttcagtgttcattctacaaatttttttttttttttgagacagagtctcactgtatcacccagcctggagtgcaatggcgcaatctcggctcactgcaacctccacctcctgggttcaagtgattctcctgcctcagccatcgagaagctgggattacaggtggccgccaccacacaggctaatttttgtatttttagtagagacggggtttcaccatgttggccaggctgatctcaggtgatctgcccaccttgacctcccagagtgctgggattacaggtgtgagccactgcacctggcccattgtacaaaatttatcagtgcaaactgtgtgctgggaaaagagtataaaatattaaaggtgaatggttgctttccctggcaaaagaccctttagaagtgtagatggcattaaatgctgcttccctgagtatgaagtagcctcatatcttctgactcctatactggatgtgtattctagtagtcctggcctcttagactcattttcagaatgtatgctggttagggtggaattatcatcagtgctgttctgtgcctgcccagacctcttgggcttattgaggtcttgtgtcccagcccttttgttttgactcctgtcttagtcttttctgtgttgctataatagaatacctgagactaggtaatttataaagaaaagaggtttgtttagctcacaattctgcaggctgggaagttcaagtgcatggtactggcttctggcatcagctttcatgctgtgtcatacatggtggaaggtcaaaaagggagacaagtgtgaagagagggaccaaacagaaggagacttgctttgtaacaacttgctttcttgggaatgaatccattcccaggagagcgagaagtcactcctgtgagacagcattaatctattcatgagggatctgctaccatgacccaaacacctctcataggccccattttcaacactgctgcactgaaaacgtttacttttggtgaggacaaatgacaccgaaattatagcaactcctagtgttgaacaacagaaatatcttcctccatctcaacagctactttcccttcacactttcttatcaatcccagcttcttttatgagatctggtatgtcctgtatgtcctgtgaaattaggttggtaacaggatcttttttttttttttatgttttttaggaatttcaaataaatgagcaggtccttgcttgctggtctgattgtcgtttttacccggccaaagtcactgctgttaacaaggatggtaaggcatttgagttgtagttgtttttactcatgacttaggtggtggggggggatgtttgtaatatcagagcttgatagtatattttcagtatttatttactgcctaggtatccgctttattcaagttaatcactatgtcaggagttgggtagaaattataagtgtaaagaaaactggacaaaaaagatagtttgactttttaccccctgaatttcagtcattgttttctaaaacagtcacagttcatctgtcactctgcctggaagtatgcaggtacttgctgtctaggagttcctaatataattgatgacatagtcctgaatatttgtgaatagcttagaaattaaatgaacactaacaaactttaaaaaatgtgctttctagatgcaaggtgactgagggtggtctgtaacattggagttgctagtggaaactgggatgccggaatttagagcactgagttgggtttcatttgccagagttgaacatgtgaagagacaggatggggaacttgactaatagaggctcaattttgctagtaaaagggcagacaaagagttatgaggataatatgtacggtcaggatcctggcacctggagaatagagtctgggtcccagtgataccattgtaagcacattccactagggtgtgtgtggtctccatgatctctgaagtgagtgtttagggaagtcaggcctcttgatgccactgtagggttgactattaggccagcctgacttttcatttgatgaagttattcagatatttattaatactctgctaactgctgggcctcaggctgaccaagttttgtctgagaatgattttttttttcttgttcttttttgggacagagtcttgctctgttgcccaggctggagtgcagtggtgccagctcagctcactgcaacctccatctcctgagttcaagcgattctcctgcctcagcctcccgagtagctgggattaccaacgtgcaccacggtcagctaaattttgtatttttagtagagacggggtttcgctatgttggccaggctggtctcatgtgatccacccacctcggcctcccaaagttttgggattataagcgtgagccaccatgcccagccgcaactttttagaaaagtatttttcaggccaaacacgatggttcttgcctgtaatcccagcagtttgggaggctctcgtgggaggatcacttgaggccaggaatttgagaccagcctgggcaacatagtgagacctcatctcactatgaaaaaaaaattagatgagtgtggtgacatgttcctgtagtcctagctactcgcatggctgaggtgggaagatcccttgagcccaggagtttgaggctacagcaagctatgatagtgtcattgtactccagcctgggcagcagaacgagactctgtctcttaaaaaaaaaaaaaaaaagtcttttcagttgtgcttcctccataagctaaaattataggagggagagtctcgaggctatgatagttcctaaaatggtcatttgcaacgctaatatcttgtttctgaagctccatattctgtccagtgaaatttagttaattgaaggacatgaaaatgaatggaaatttctgccaaaacctgttgtcctgaggttcttgggtctgaagtcctgtattatgctgacacattgactggtttttgggactaactggaagagggaggagaggatatgggagaggggcaatcctgaaacagaaagttagtggggcaggctgggtagtactattggccacccagattgtgaaggaaagctagcctttgtaggagctcagatctatgtctgattcagagatgaagataattaatgcctctaagaggggtgggaaggtgtcttggtggaggcaatgaaggcttagtaatctactgtttagatctaatacctgcagagcccagagcttggcatcatgaagtaaaacaaaagaagacctgcttcaaagtagaatgaagtaggtgctgaaatagagctaccaggaggaggcagggcaggatggtgcaggttaatcatggtaggcacctgtctctataaggttttgtgtttgtgtgtgggatggatcagaaactctttgaaataatgatttcaaaaatgattaggtttggattagagctgatggtcagtttgtgcttcatcacgattcactgtgggattacttgtgggattgggagcgacaatgctagtctctcttttcactctttccttggtattttctgctgtgcctcaggttcattcgtagcagtggccaccagcttaatggccctgcgaggagaagctctgccggcaaggcggcccctttatttcctgtaaatgtcacttatgtcttgttggtgctgccaggaggaggcaggggatatagtgaagtcatgccttgtagatttatctttagaaggcttggtctgattttcttgccactcttaatctccttggatgttttgctaaagctgagtgttgagcaggctggtgggtggggactgtagccagagtgtggaagtggcagctgctggcactgaggagtctggcatgattgaatcagaactaaataacaactttagtttcttaaggaagtctgttagcactcggaaaatagggcatataatgccatattatttagcttttttcacctggagtggttcttcagcagtggagattaagcattatttagtacgaaggcagcggcagttggtagccttgttagaccctcagtctgtgttgttacaaaagacagtaaaagatgggtttctactttcagggaatctttgtttggaagccatctctggtgagctgacctcacctctttgctggggctgcttagcttccccctccgtttttttttttttttttttttttttttttggtgacagaatcttgctctgttgtccaggctggagtgcagtggcacaatctctgctcactgcaacctccacctcctgggttcaagcaattctcctgcctcagcctcctgagcagctgggactacaggcacatgccacaccacacctggctaatttatatatatatatatatttttaaggtttcaaatgtactttatttcttcattaatgccatatcttaatgggtacacagtgctttaacttggcatcaattatgagctgtttttttttttttttttttttttttttttgagacggagtctctatgagctgttttttaaacaattcattattacatcagctggtatgattactgttctctccattttggggggtgactctgccaacaggggatgggttccattctattccaatttgtgttgttatatatgtccacatagcaatacagaaagtgggtccactagctaatacagtattaccatatttgttatgaaaatcaggtgtatgtttctggtggctctgccttgccattgtttgctgaatgcttcgaacttggagatgactgagtttgtttttgaccaagggaaacatcgtgaaggtgaagatagaactgcagcaatgaagctgctgctttaatttttgcatttgtaggagagacagagtttcactgtattggccaggctggtctggaactcctgacctcaaatgatccacccgcctcagcctcccgaatctcccctttttttcacacaaggattagcagagtcagttgtctgtcagggctttttgcccccagtagtgtacaactctgctctgtaagtgattttctttaaggaaactactgtgtaggttagcatttatgacaaaatggggaattggtcctttctgttgatctgtggttctttaacttgaatgagcaggtaaatcagctccttcttcctaaaaaatatgcatatttttgggtcatgtcccctacctaccctgccagttcagtctctggggcagtgactgaagtctgcatttataacaggagatgctatggaaatgatcttgtttctagagtctctggctgaagcagctcttattttttgttttcttcatgctgtaactgattctacatttgaaatgtggggaggctgatactgtgtgaacagctttgtagaaagagaaaaggaagatttaggcccacacgtgcaggtgctagcttggctgttttcttctattgggggaagagggattgtgcttcccccccaacccccaccccgcccctttttttttgcctagatagcctttaacgatgtcaatgtctggccaggcgcagtggcttatgcctgtaatcccagcactttgaggggccggggcagcggattacctgaggtcaggagttcaagaccagcctggccagcatggtgaaacctagtatctactaaaaatagaaaaattaacctggcgtggtagcatgtgcctgtagtcccagctactcgggaggctgagacagaagaatcgcttgaactcaggaggcagaagttgcagtgagctgagattgcaccatactgcactctagcctgggtgacagagcgagactccgtctccaaaaaaaaaaaaaagatgtcaatgtgctgtgcttcccttttagggtgacttggtggtattgatcccttggtctgtgacaggccctgtgctaggttgtttccatatcttatcgtatttagtctttacacaaacatggaaaggttattgccattaaccccattcttattttgcagatgaggaactaagctcacagggggaaactgcttgaggttataaagcgcttggatggtagagctgagatctgcatggaggtctgtggttctacagagtccctaaactgtcgttcccacagtaccaggctgcctctttggagcagggttttcctaagagggcaggtgttgtcaattaggtccaggtgttcactgatagaatgcgagagtggatgtagtggtctgcactttctggagccggtgttgtcttgagaaccatggttgggagacagggtctggtcccagctcctgctcagtgattatgggcggttcactgcctttgctctggactcttttgagcagttagaagtcaaagagggagtgggaatagatgagtgttgtattggccacagaacctaaacccaaaatgtaaaattgctaagaagaaaatacttagagggaggggaaggcatgcccacaaacatatgcacatccccacccctcaatctgtggaagcctaaggacttcaagaaaacttttttttttttttgagacggagtctccctctgttgcccatgctggagtgcagtggctcgatctcagctcactgcaacctccgcctcctgggttcaagtgattctcctgtgtcagcctcccgagtagctgggattacaggtgtgtgccaccacgcctggctaatatttgcatttttagtagagacggggtttcaccgtgttggttaggctggtcttgaactcctgacctcatgatccacccgcgtcggtctcccaaagtattggaattacaggcgtgagccaccgtgcccgacctgactaatctttttttcctttttttttttttctaaaaagggccagtccaggcgtggtggctgacgcctgtaatcccagcacttttggaggtcgaggcaggtggatcacctgaggtcaggagttcaagaccagcctgtccaacatggtgaaacccgtctctactaaaaatacaaaaagtagctgggcttggtggcgcgcacctgtaatctcagctactcgggaggctgaggcaggagaatcacttgaatccaggaggcggaggttgcagtgagccaaggtcgagccactgcactccagcctgggcaacagagcaagactcgtctcaaaaaaaaaaaaaaaagaaagaaaaaaaaagaaaagactagttgaaagcagttgtgagaagaaaggaaagagtagaacaacaagttcgatctgtaactaactgtgaaccatcaattgagataactcactactttcagaccagcctgagaaaacatgtttgaaaaccctccgttttccatctgtggcattctggaataatctgacttccgaagagtgaatgagatagaaaagaagccctggacgctgggcaggatggcacacatctgtaattccagtgcttttggaagttgaggaggcaggattgtttgaggctgggagtttgagaccagcctgggtaacatagaccccaatgccccgctatctctacaaaaaactaaaaaataaaaaattggctggacatgttggtgcatgcctgtagtcccagccacttgtgaggcagagacagtaggattgcttgagcccaggagtttgaggctgcagtgagctaggttcgtaccactacactccaggatgggtgacgaagaccctatttctttctttttttttttttttgagatggagtcttgctctgttgcccaggctggagtgcagtggcgcgatgtcagatcactacaacctctgcctcccaggttcgagtgattcttctgcctcagcctcccgagtagctgggattacaggcactcaccatcatgcccagctaatttttgtatttttgtagagatggggtttcaccacattggccagactggtcttgaactcctgacctcaagtgatccgcccgcctccacctcccaaagtgctgggattacaggcgtgagccaccatgcccggccgatgaagaccctgtttctaagaaaaaaagaggccctggaatattggctgtggtagatttcatgagcaacagaaatctgtccaatccaaaatcacccatgtattatccctatgtctttggtcctagagaacatgagcttgttatgcatctcagttttgttcttagaacccttttagtgttactgactgctataagattgtctgcaatgctgagtccttaaccctcagaggggcaagaccaggaatctttgtttcatcttaaagtctaaggacaaaaactccttgagggagtctgaggcaggtagcccttctgtcacgttagaggagatggaacaggatacacttattttgagttccttcatttacatgttgtttgttaggtagtgtttgtggccacaggagaactctattattagctacctacgggaggattccatgtgaagacaatcttttagtaatatacatgaaaccatctgagtaaaatgtgggcctctctgttgtccattattctgtctgatttattgaagcccaagttaggctgtgtttagcatgaaagtttcaagatgatcctttgtagtcctttggaagttaaaaggatcaaagaccgagatatatctaaggacggtcatcccttagcacctttggccatagtttgggtcatttcagcactctgaaatgggtctgtggtttggaattagactgaggagcttgagcaataggcagtgcggggtggtgggaaaaaattggttggaggtcagtagacaggcttggattccaaagatagctgtctcagacttaatcatggaactcaggttccttttatgtaagtcctccttctggaatctgccatcaggagtaagcttcaaaattaactccaagtagctgaaaatgttggactgttaggtaacattactcaatattgacttttggatgttggaaatgcctgtaaaaatggcagttttcattttgatgtaactgatcctgaactaactttgttgataaaatagttgaaagtagagtcttgggtggtttgttggcacacataatatttaagatttcaagataactggagtcttaaaactcccatccccccatctccgtccccagacttgccagagttgcaccatggttgcttgagagggttctgtttagaattccatagcattgtttatcataactgctttgcttgccaacaccctgacaatataggcaggtaaaaacaggaacccagacctttgttgtaagtactcataagtcattgctgagctgcctgtgtagataattgtttatgctcttatccttttatgttcttatccttttatcatagcctgttcatctaattgttgttgtcatctaattgctgatgttttaacccaaccaggcataactatgtatctttatatcttgtttgctagccagtttcttttttttatatttttaatttttttaaaaatttttaatttttgtgggtacataagtgggtgtatgtatttatgagttacatgagatatcttgatacaggtatgcaatgtgtaataatcacatcagggtaaatgggggtatatatcacgccaagcatttatcctttgttacaaacaatccaattatgtagttattttatttttattttttattttttttaggcagagtttcattctgtcacccagtctggagtgcagtggtgtgatcttggctcactgcaacctccacttcctgggttcaggcgattctcttgcctcagcctcctgagtagctgggattgcaggtgcccaccaccatacctggctaatgttttttgcattttttcagtagagacagggtttcaccatgttggccagacaggtcttgaactcctgacctcaagtgattcacccgcctcggtctcccaaagtgctgggattacaggcgtgagccatcacacctggccaagttattttaaaatgtacaattatttttgactatagtcaccctgttgtgctagcaaatactagatcttactcattctttctaacttttttgtaccccttaaccatcgacacgttcccccacccctgcctactacccttcctagcctctggtaaccctccctctactctctatctccgtaagttcaattgttttaatttttagctcctacaaataggtgagaacatcaaagtttgtctatgtcttgctagctagtttcgtcatgtattggtgacacctgtgacaaataatcacctttattttgtaattaccaggaataaaggtcagtaggtaattactaattgtctatggcagtggttcttggactttggtgtacatcagaatcacctggaggagttgttaaaaatgcacattcctgtgccctgttcccagttgctgtttcagtgtatctgaggtgggactggtaacttgcatttctaatgagttcccaggagttgctcatgctgctgctgtgggaccacactttgagaagcactggtttactctgaggcaggtactgtgtgtggaagaaagtggtataagttatggtctctggccttgaagagcctgcttttgagttgtgatctgtacttatatgaaggtagacctaagtttgaagctctgtaggctggtgccaaatgagcctaagaagttcagatcgggggtaatcattagtagctgaaaagcccggaagcttttacagaactgttgtgggtatttgagccaggcacttaaagatcagtgagtggcacattcccagaaggaaaacacttttaatacagatgtggagttagaagtgtcgctggcagtttcagtgggtagcttgtcactttgagttggtgggtattggatggtggtaatgggaaataaggtttggaaaattattggggtcagattgtgttggaggttgaatacttttggacttcatttggtacccgtgattagccattgactaggccctgttgaggactggcggtggaggggtgtgggaagagaatgtatcagaaggagaaaaccaggtcttaactttgttgttgcattcttcggctcccaggcctcagggttttttgcagggggtgggggaattggttctaaaaagagaaaaacctgtttactagtggaaaccattacgtgattaccaatggtttactgaatcttgacaagattaattgtgattattttaaatccctggggcaaaaatgggtggggcatgaattggctctaagatgcaaaatttgaaagtgttgtttgggtacaactaatgagaacttctgtagttggacaccttatttgggaagataagattatctgggtttccagcttaaggtttttagcagggacggatctttattgaataatttttttctaatgggaaaaaactaacagtgtagcagaaaaaaactaacaatgtagcagcaaacattttgtgttttgaccaagtctctattttagaacattgtatcatgaacataattcaaatggattttgagttgtggaaatagaacacatctcttgaaacacaatacctttagctgaatgatgttccttttttttttttttttttttttttgttttttttttggagaaggagtcttgctctgttgcctagcctggagtggagtgcgatggcaggatcttggctcactgcaacctccgcctcctcagttcaagtgattctcctgcctcagcctcccgagtagctgggattacaggtgcctgccaccaagcgcggctaattttttgtatttttagtagagacaggtttcactatgttggccaggctggtctcgaactcctgaccttgtcatccgcctgcctcggcctcccaaagtgctgggattacaggcgtgagccatgatgttccttttaaaacttgagagctattactgcccccgatcccggaacgtaaagattaaattataaaagtgaaaaattcaccaaggaataaataagtctgcattttactcactttcttaattgttttactgctctttgttcttcacttaaattcagtgaaattttttttattttaatgaagcatctaaaaacaagtttatttttttgatggatttcaatttacgtaggtagaaaactaatcttaactaagaaatgaagataagcatactgttatcttggacataagtaagactgaatatgattcttaaacagttttaaactcctataagcttattatgtggttggagatcccttgtgtttatactttgaaaagttaccacttttcatgaaattgtgagttaaaatcatgatatcttcttgaattttaggtacttacactgtgaaattttatgatggagtagttcagactgtcaaacatattcatgtcaaagctttttccaaagatcaggtgagaaatgtggttttgtgctttgtgttatgaataatgctaacattgtagttttgtttcctcaaataaagacattacatttgtttatgatagcaagtgtttatttcctccatctgacacaatttcaccagaaaataatacacaagttttcagaagttgtaaatatttgtctctttgctgtttcctatttatttatttgtttatttagaaacagagtcccgctctgtcgcccaggctggagtacaatggtgcgatcttggctcactgcaacctctacctcctgggttcaagcaattctcctgtctcagcctcctgagttgctgggattataggcgcacgccaccatgcctggctaatttttttgtatttttagtagagacggggtttcaccgtattggtcaggctggtctcgaactcctgacctcaggtgatccacctgccttggcctcccaaggtgctgggattacaggtgtgagccactgtgtctggccactgtttccttttaacagagattttttttcaaaagtgccaaatgcttggataccattgcctatattctgttctcctaatcttttttcaacaatggttattcttttcttctctctgtgccctgcgccccacaagagctgttagccatacaggaaacttgttgaattgcttgaggagacctccagtatgttttctgtccatctagctctgtcttttagcttaggaccattacttggtggtttacagagctatcatttggcacagatttggcagccacttgtgctagatgtgcctggtttgtgattttggtatcctgttgttccagtcaccatgcatgtacttgcctgagcatggggcctcagttttggtactggaaatatggtttgcatagatacgggccatctagaagtgttgcctactttcttcatgatttttccccttttgtctttttcgtgtttatgttttaatagttgaggggaaaatagagatcaaaatttggatattagtctttttaaaaatcctgattattactaatttcagctgttgagacagctaatttagcaatttagtaaaagattttatcactgaggcatcataacttgctactcatctgcttggatagtagttgatgtgacaatatttggtgatgctataacctgttgtgtctttggtttttggtttttttttttttggagacagagtcttgttctgttgcctgggctggtgtgcagtggcgcaatcttggcccactgcaacttccccgcctccccagttcaagtgattctcctgcctcagcctcccaagtagctgagactaggcgcgtgccaccacgcccggctcattttttgtattttggtagagacagggtttcaccacgttgtccaggctggtctcaaactcctgagttcaggcaatctgcccacctcggcctcccaaaatgctaggattacaggcatgagccattgcgcctggccctctgttgtgtctttgtgatgatgaaatgattctacttatcagagatttttaatgaattcttctgtatgtatatttgtaagttgtgttttttttgagaccgagtctctgtctgtcacccagactgaagtgcagtggcccaatctctgctcagtgcaaactccgcctcccaagttaaagtgattctcgtctcagccttctgatttgctgggattacaggcatgtgccactacgcctggctaatttttgtatttttagtagacggggtttcaccatgttggccagggtggtcctgaactcctgacctcaagtgatccgcccaccttggactcctaaagtgctgggattacaggtgtgggccaccatgtctggcctattcataagtttctaagaaatttttttttttttttttttttgagatggagtctcactctgtagcctaggctggagtacagtgatgcaatctaggctcactgtaaactccacctcccgggttcaagcaattctccttcctcagcctcctgagtagccgggactacaggcatgcaccactatgcccagctaatttttgtatttttaatagagatgggggtttcaccatgttggccaggctggtcttgaagtcctgacctcgggtgatctgcctaccttggcctcccaaagtgctgagattacagggcatgagccaccatgcccagccgattcaaaggattttgatacatgatacctttagtggtaacctcaagaatgtttttgccttttgctggttttccttttcagaaaattaacaaaattattacataaagctttggccctgatgatgctttttctttgttcacttgtctctctggcatgtaaggagccatacagtactctaaaacattattttggccttaaatttggcaatttttgtgttaggtttgtagaacgagttaatatagaggacagaattataaacttgtccagaattggcaggttatatccagaaccttcccaagtggaagtccagggctctagataacaattgttcatctgtttactctgcgatactcagtaaattgatggatagcactcacagtgctttggcttggaggtgggtgccttacccagtgaggatttctgggtgccatgcttcatttctcatttcccaatggcctctgagtgtctgaccttagcccggtaggcccttaagcacaggcccaaggctcctggacttggcttcttttccaagagggtacagtggtttggctagagttatctgtcatgggcaatttcaaaggtttttcgtatactattggaatagattgagttttttttttttttctgtaggactgcactgccttataaatgttttgatagtctctatattagtaacacttatgtttttgaagttataatacgtttactgtagaaaaatatataagtacaaagcacaaagaaaataaaaactataattccatcaaacagatatcattgttcttaacgttttggtgtgtaacttgacttaacaatttgatgtatacatctttctgtgttttttattaaacgtacgtgtgtgtatttatttattttcaaaattggagttgtggtacattaatatagtactgctcttttaactaacatttccccatgttccttaatattctgagaatataatttttaacagctatgtagtattctgtaatatgtatgtaactactttgtgtaaccaattcccaaatggtcattaaggatatttgtaaatccaggtacacaagtctgattattattttagctaattttatttctaggaatttattctagttcaaaggtataacctttttagttttgactcaaattgccatctcctccctgaactcccaacaagaagggcaatttcagtttatatttctgctggctgttaccgagaatgcctgttctcaaacctggctgctttcagaatagtttgggggacttgaaaaaatatttccttgtttattatttttccctgtagaacaaattaaacttttatttgttgagtatttaggtactccttcctgcttccagtgaaaacctatgtgcctagtgtgtgctaggtgctgggcatcccatatgaacatagtatggtggtctctgctcttttgaggtcctagaagagagatatgtacacaaataaacttaattatagttttggaatctctagagctttcagacctggccttattatgaaacagtcacaatagaggaccctcgatttttagtgtgaattttaaagaatgtaatttagggagaacataactaagaagcggtatttcctaccaatagacaaaaactccaagtagctcaggaacatagtaggtggcttgttgaactgagcacagcctttacctgatagagaaagcagagaccctggttctgggttggataatctttatagttttcctgttaagcttccagttatcagtttttgtttttctatagacaagacatcagcatttgctggcaaactgaaccaggcctctgaaaagctctgggtcagtatagtcatgctggggataaggacagagcatgaaggcattttcttcgaacacctttgtcagaaagattgctttccagaattttaaggccaggcatggtgactcatgcctacaatcccaatactttaggaggctgaggcaggaggattgcttgagcccaggagtttgagaccagcctgggcaacatagggagaccctattgctacaaaaaataacaataaaaaacttagctgggtgtggtgaaacatgcctgtggtcccagctactcagaaggctgagatgggaggatcgcttgggcctgggaggtcgaggctgcatgagccatgattgtgccactgcattccagcctgggcaacagagagagactctgtctcagaaacaaaaacaaacaaaaacccagaattttattttctagtgacttattcgtcataataagggagattgcactgtctccggaataattgaattgttttaagtttaaggattggttctcaactcagtacaggtggctgttgtcagtggtgctttgtatatgtgatctggcgtatgtcttgttttaatttctttgtttgtcttcataagtttgtaagaaactcctaattttgtatttgcaagtaatcacgaagtgtttcatcgctattttgctcattttagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactggtgagttttttaagtgggctctgcaatgggcaatgccagagtattcttctgtggccctttgtggttctttgtaacttgtgtacgtcaatcgtttatttttgtgactgattttgaattgtcttatgatctggaaacaagttgtgttcatgaagctgaatttaagtgaggtacatatccaagtgaatctaagttgggaagcatgttcataactgagtttgctaaagtagtggttaactgttgactagatacttcagcttatatgataaaacctgataaaccgaggccttttgcttatgctttttcaaatgatctcagtttaagtcagcttaatagaatctagaatcaggaaatagagttttaatgagacagacatgaaagaaaagtaatagtaaaaaggtatgggcttctgaaggagatggggacaaaggaacattgaaactagaaaagcatgggtgcattttgaaattgagctccttggagagtgattattgattagaaattttcacagtctaaataaaaagccgagatggctaattggtaagagtcaaggttagagggtatagatttagggaagaatgcagttattaaaaaacttaaaatttggaattcttctagaataaccaagaatgaaacaagccctgatttcttcctaagccaaacactcgttctccaaatcaattcaatggcatgaagaggcccccccggttctctggactgagcctgccattgattaatatgtgcagtgaccttcagacattcttgattgtgcattctttatgtgttcagttgaaaaactgtgaatcccctagcacgttttaaagcagtatttatctttttctcacaagtttaaatagctgcagtggatacatttaaaatacaaaacatgaaggctgagtgcgttggtgcatgtttgttgtcccagctactcaggaggctgaggtgggaggattgcttgagcccaagaattccaaaccagcctggacaatgtagtgacaccccatctcaaaacacacacacacacacacacacacacacacacacacacacacacaaatattttcatcaaaactgtggaactacagagcaaaccttttcattattccctaacgatgtagagaatgcaaagccagtcttccttatcaaatcagactatcagacttaatttctgtggaaaaaaatttaacttacttcacataagtgtattagtactcattgtaagataggaaattatataataggttgatttgtctctatatgaaataagggatctttccctgtagtgcttgtaactgggttttgccctcaagagctgagggtgctgcaattgtctgtaggcctaaatagggcctagacctctgctgtctagtatggtagccactagctgcatggggctattgactacttgaaatgtagctagtctgaattgagatatgctgtaagtgtaagtaaatgctagatttcaaatacttagttcaaaaaaagaatgtaacacacctcgattttaaaatactgattacggctgggcctgtaatctcagtggtttgggaggtccaggcgggtggattacttgaggttaggagtttgagaccagcctggccaacatggtgaaaccccgtctctactgaaaaaatataaagacaaattagccaggcttggtggtgggtgcctgtaatcccagctactcaggaggctgaggcaagagaattgcttgaaacccaggaggcggaggttgcagtgagctgagatcgggccactgcattccagcttgggcgacaaaacaaaaaaaaattgattccatgttgaaatgtttttagaggctgggtgcagtgcctcatccctgtaatcatgccagcactttgggaggctgatgagggaggatcacttgagtccagaagttcgagaccagccttggcaacatagtgagacctcatctctacaaaaaatgaaaaaattggctgagagtggtggcacgtgcttgtagtcccagcgattccagagtctgaggcaggaaggttgctgagcccagtttaaaaaaaaaattttttttaaagtactggattaaataaaatagtatttaaattaactttttaagttgtgtttttttttttttttttttttttttgacagggtctcactctgttacctaggctggagtgcagtggcgtgattgtggctcactccattctccacctcctaggctcaagcgatgctcctatctcagcctcctgagtagctgggactacaggcacatgccaccatgcccagctaatttatttcttgtagagacagggtttcactatgttgcccaggtttgtctcaatctctgggcctcaagcaagcaatcctgccttggcctctgaaagtgctgagattacaggcatgagccaccatgcctggcacttaaaaaccaaaccctcttatgtgatgagtaaaaaattcaaaattggccaggcgtggtggctcaggaatttgagaccaggctggccaacatggtgaaatcccgtctccactaaaaatacaaaaattggccgggcatggtggttcatgcctgtaatcccagcattctgggagaccaacatgggtgggtcacctgaggtcaggagttcgagaccagcctggccaacatggtgaaacccccatctctactaacaacacaaaaattagatgagcgtggtggcatgcacctgtaatcccacctacttgggaggctgaggcaggagaatctcttgaacccaggaggcagaggttacagtgagccgatatcgcaccactgctctccagcttgggtgacagagcgagactccatctcaaaaaaacaaaaaataataaaataaaataaaattacatgtggcttgcactcttagtatatttctgttggacagcactgactttatgttcactggctttctcaactgagttttgggagagaagccacaatacccaaggcatccttgatctgtgatggattgaccttagtgcattgagaatggtactagctgtataccacccttaggaaaacagagaaaatatatctctgttcagatggggaaccccagttgagaaaatctggaagttttaaacctccaggctgagcaccatgttaagatgtgggatgagtgagaggcaggcccttttatgtaaagtgggagaagggcagttaaaggcagttattatacaaggagaggtggaaaatgtaaactggcagaaatctgacatgtccttaggcagaaatctgacatgtccttagctcagtttaggaaagagtatgtatgagaattgagtgttttgaaactaattctcctttaggtattcatgccctggcttataccctccagaaggtatgtacagaagtagttgtaccccaacaagcagactgctcctttgaagccacatgactccattgagataagaacaaggacattcagtttttatatttttataagtgtaggatttcataatgagtaggataaatttaatatagaagggatgttttctaagtttatggttaatccttgcccaaggcatttgtgaaaacagattccagccatgcctcagttcttttccagtcagactgtctggatgggaatctgggaatatgaattgttaacaagcttcccagatgacttatactgtaagaagagtttgggaaacactcaagttctgtacagtcagctcctatttatatacggtatcaaagggaagaagacttgccaagtatcccatatattgttcacatccccttaaaacattacttggaataagttcattgatttgtagagccttccttgagcaccctagattgtatagacttgattgggaacaggatctgagctatttagagagggttgtttatatatattttaatttttatttttttgagatggagtcttactctgtctcccaggctggagtgcagtggcatgatctcggctcattgtaaccaccgcctcctgggttcaagtgattcttgtgcctcagcctcccaagtagctgggactacaggcatgtgccaccatgcctggctaattttttgtatgtttagtagagacagggtttcaccatgttggctatgctagtcttgaactcctgagctcaagtgatctgcctgtctctgcctcccaaagtgctgggattacaggcgtgagccaccacacccagcctgtttgtatttatgtttaacttggaatgtgtgggatttccaagttctgccagttggaacaaaataatattggcccattgggaagttggaacacaggaagagcctcagagttcaacagtcttctctggtttgcttcctcacacttcaggccgtgtcttgttgagccatttgaccgacctgaagctacaggtcttagatgagtcttttctgtccctcttcccctcttctcatctttctcccttcccttcctcttttcctcccatttacttctcttcttccctcttcctttcctccttcctcttctctctcctcctttcacccttcctgagaccccttagctctgccttcctgcccaacttcccagtttctttcttctgcctgccttttcaattctcatcttttctgatttggggtaagcttcttaggtggtaggtttaaaacaaaatagtaagggctgggcatggtggctcacgcctgtaatctcagcactttgggaggtcaaggcaggcagatcacctgaggtcaggagttcgagaacagcctgaccaacatggagaaaccctgtctctactaaagatacaaaattagccaggtgtggtggcgcatgcctgtaatcccagctacttgggaggctgaggcaggagaatcacttgaacccgggaggcagagcttgcggtgagctgagatcgcaccattgcagtccagcctgggcaacgagagcaaaactctatctcaaaaaaaagttaatagtaaatactatgctgggcaggtggctcacacctgtaatctcagcactttgggaggctgaggcgggcagatcacttgatgtcaggagttcaagaccagcctggccaacatggtgaaaccccatctctattaaaaatacaaaaaaaaaaaaattttgctaggtatggcaggtgcctgtaatcccagctacagggaaggctgaggcaggacaatcacttgaacccaggaggcagaggtagcagtgagccgagatcgtgccactgcactctagcctgggcaacagacccagacttcatctcaaaaaaacaagcaagcaagcaagcaagcaagcaaacaaaatctaaatagtaagtactcttcaaaggcttagcgtctgtactgctaaattatgtcagagctgggtttgctggggaccagcagccttgcctgaaacattgactgttaactagcatagtctcccaagaatttttttaggattttgtttaagaaaatacaaattctcggctgggtctcatggctcatgcttgtaatcccagaactttgggaggacgaggcagctggatcacttgaggtcaggaatttgagaccagcctgaccaacatggggaaaccgtgactctactaaaattacaaaaattagccgggtgtggtgtcgggtgcctgtaatcccacctactccggaggctgaggcaggagaatcgtttgcacctgggaggcggaggttgcagtgagcagagatcgcggcactgcactccagcttgggtgacagagcgagactccatctcaaaaaaaaaaaatccacaaattctcttggacatttttcttgtaccctcaaaactaggcccagtgctaagataattaatgtagcaagtagaggttgaaaactggagctggatcatagaaaagattcaggaggtcaattggcaaggtatcaccatctcctgtaaggaagtaatttctcactcattttactttttttcttttatcttaagtaagaatgcccttttgatggcccatttataatgcagtgatttctgcatatatatatgtatatatgttttatttatatataaaaatgacagacactaagaaattatgtatctttttttgtgtggttttataaacatggtagctgtggattcaaactctcaaactttgcaaccaataacattggaactgagaagaaggaaaatatcaaaaggatgtgaagtcccattaaaacgtcctcggcttgacaaaaattcatgtgagtctacagtttgtttatgtgtggctagaatttgacgttgtttgggtcaacttcctctatattcatcctgtcccccattccctataggctctaatgtttgtctctggtcacatgaggtaatgtgagttggatgcagttggatcagaaggagtttttgctagaagaaaaataaatcccaaagcacaaactgtactaatgttgggttctgtggtatcatctccatatccataaatcacatttgatttggatgccactggaaatttaatggcttaggaagggatgggtttcatatgcagagtgaaactttaaaaatactacttattggcctggcgcagtggctcatgcctgtaatcccagcagtttgggaggctgaggtgggtggatcatctgaggtcaggagtttgagaacagcctggccaacatggtgaaaccctatctttactaaaaatataaaaattagccgggtgtggccaggcgcggtagctcacgcctgtaatcccagcactttgggaggctgaggtgggcagatcatgaggacgggagattgagaccatcttggctaacatggtgaaaccccatctctactaaaaatataaaaaattagccgggtgttgtggcaggcacctgtagtcccagctattcaggaggctgaggcagaagaatggcatgaacccgggaggcggagctagcagtgagccgagatcgcgccactgcactccagcctgggcgagagagcgagactccgtctcaaaaaaaaaaaaaaaaaaaaaaaaaaaattagccgggtgtggtggcgggtgcctgtaatcccagctacttgggaggctgaggcaggagaattgtttgaacttgggaggcagaggttgcagtgagccaagactgtgccactgccctccagcctgggtgatagagtgagactctgtcctataaaaaataaaaatacaaaataaaatactatttattgatttaaaaaaataccctctggagtgagttggctcaaatgtttaaataaatttaaaataaaatagtatcctgttggctccaaaaaggatttgtgatagctctaagtaaggctcttataaacctttttaagtcgactttgcaagttagtacatttgggaagccccaaaatagaacatagttgtcaagattcggacatgacctagcacatgttttcagaccatgaatccttaaagaagtgaaattctatcctggcagggacacttttcccttacttaaaactgtaaactagtaaagggtatttccttttatcactactctaacattccagtagtctctctgtaaagtccttttagagacatccagccctgaaatctgtagtagcacagttatttcttcttgttggtctcttgactacaactctcttaatggtttaatagcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtgagtcagtctgttcaggaattgtcttgccaacctggttcctatttagtgagaatcaatgtaaatcattatgttctgccttccacaagtattaaattgtcttgaaatcaaactattgaatgtgctgcagtgtttttataatgtattgctcttcactgatgatttattcaatagacatactttctggatgcatttgtggttggttttgcttatctaccgttcagtgttggcctggaggtacactgttcgaagagccctgcttctctctctctgctgccatctcattcgtgcctttgtgtttatacttccagctatttttcctttcactttaacctctttctttgagaagctcacaagccagcctgtatgtatgggaacctgtgaatgtatgcttttatgttttagattaattccttcctctaaaaagtccctggctttcttagactgttgtaggacttttgatttcagaattacatacatgtatatttcccccaaactttctttttttcttctaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaaggttcatatttagagttaaattaatcctctttttatatacacttttgcttatgctttgtgaactaaaaaaaaaaaaatgacttttctgttgttgtttttcaccttttattaatattcccttatcattttaatgttatgctcctttcatttctgattttgataatttgtgttccctctcttagtatgactagggctttatctattttgttttcaaagaactaactttttacttcaattttctctattgtttatttttaaaaatataattgatttctgttttgatcttgctttcttccttcaattttttctagaactttacctaattgattttagatctttcttccttttttttttcattacctggtgaaaagatctttcttcctaatatgagtatttaaagttataaatttctggctgggcgcgatggctcatgcctgtaatcccagcactttgggaggccgaggtgggtggattgcctgaggtggagagttcgagaccagcctggccagcatggtgaaaccccgactctactaaaaatacaaaaattagctgggcatggtggcaggcacctgtagtcccagctactcgggaagctgaggcaggagaattgcttgaacccaggaggcggaggttgcggtgagccaagatcatgccattgcactccagcctgggcagcagagcgagactcagtctaaataaataaataaataatgaaattatacatttcccactgagaactgctttagcagcatcctacacattttgatacgttgtgtttttatttttgttcaatttaatatatcttgtgatttatttgttgaccatgggttacttagaagtatgttgtttcagtttgaagtattttatgtttttgtagataccttattgctattgatttctaatatagttttactgtggtcagagaacatactctgtaggatttcaatctttttatatttgttgcgatttaatttatggtccagcatatgatctgtcctggtgaatgtttcatatgcacttgaaaagaatgtgtattttaccgttgtcatgtgtttgttctgtatctgtcagttagatcaaggtagttgatggtgtttctctgataaattgatttttgtggggtttttttccttttggtctagttctgtcaatttctaagagaaggttgttaggttgttaaaatctctgttattgtggatttgttcatttctccctttaattttgtcatttttgctttgtgtattttgaagatcttttagatgcatacacatttataattttttttttttttgagacagaatcttgctttgtcacacaggctggagtgcagtggttgatctccactcacttcaacctctgcctcctgggttcaagcaactctcatgtctcagcctcccgagtagctgggattacaggagtgtgccaccacgcccagctaatttttgtatttttagtagagacagggtctctccgtgttgaccaggttggcctcgaactcctgaccacaggtgatctgcccacctcggcctcccaaagtgctaggattacaggtgtgagccactatttctggcctaaatgtaattgttgatatggttggtttttaggctaacatttggctgtgttttgtctgtttttttgttttttttttttttttttttaagacagagtcttgctctatcgcccaggctggagtgcagtggtgcgatttctgctcactgcaacgtctgcctcccgggttgaagcgattcatctgcttcagcctcctgagtagctgggattataggcacccaccaccacaatcggctaatttttgtattttttagtagagacggggtttcaccatgttggccaggctggttgtctgtttatattatttgtgttttgttgttttgtttcttgttttttaggttaactgattttttaagaatttcattttaattcatctgttagcttttagctgtatttctagcattttgaaagaggttactctatggattatggtatacatccttaacttctcacagttcacttagagttaatatttaaccactttatgtaaaaatgttccattaacctcccccatgttgtagttgtcacatgaattatatctgtatatgctataaattcctttttaaaaaattttttatttacatatttttttgagatggcatttcactcttgttgcccaggtggagtgcaatggcacgatcttggctcactgcaacctccacttcccagattcaagtgattctcctgcctcagcctcccaagtagctgggattacaggcatgtgccaccacgcctggctaaattttttttgtatttttagtagagatggggtttcaccatgttggtcaagctggtctggaactcctgacgtcaagtgatctacccgccttgacttcccaaagtactgtgattataggcgtgagccaccacacctggcctgctataaatttcataatgtagtattataagttttgctttacacaattatgtatgttaaagacgataaggcaaaaagcgacagtcatatttacacatgcctatttccaatgttctttatttcttcgaagatttcttttcagcatgaagaatttccttcagattttcttataggttcctgatgacaaattcttctggtttttgttaaaacttgactttttttttttaaagatagagtctcactctgtttcccaggctggagtgcagtggcacaatcacagctcagagcagcctggacctcctgggctcaagtgatcctcctgtctcagtcacttgagtagctgggactacaggcgtgtgccaccatgtccagctaattttttttcttttctcaacttttagttaaaaaacaaacaaataagactgtgtgtctatagaattgtctactttttatttggataacttaaaaaatttttttttgaatagtttttttttttcttggccagatgctatatagttaacataaatgtagtagagcagctgtttgaaaatagtgaatctcagcactctgggaggttgagactggagggtcacttgaggccaggagttcaagactcgctatattgaaggccttgcatcaacatagtgagaccctccctcttcaaaaaataaaaaaattagcctggcatgatggttcatgcctatagtcccagctacttgggaggcggaggtgggaggatcacttgaaccagggaggtcgaggctgccttgagctgtgattgtaccactgccagcctgggtgacagaggaagaccctatctcctaaaatattttaaaaaattggccaggggtggtggctcacgcctgtaatcccagcactctcggatgcctaggcgggcagatcatttgaggtcaggaattcgagaccagcctggccaacatggtgaaaccccgtctctactaaaaatacaaaaatttgctgggcttggtggcgcacgcctgtagtcccagctactctggagattgagacaggagaattgcttaaacccagaaggcagaggttgcagtgagttgagatcgcaccactgcactccagcctgggtgacagagtgagattccatctcaaaaaagaaaaaaaaaaaattaaaagagtaccgaagtattcattcctagctcatctcggcggctgttctcttagttctctgtctagcttcgtccatagtgttgtgcttcagcctcgagggcttgtcggggcaagggatcttcctttttttgctactcctcctcttagtgtcagggctcttttcttcccagcctgctcttctgacatgtggggcaaattactaaagttcatatgtaaatgaggtggaaatttaatctcggaatttagttgtctgtcttggcagggagaactctagatgacagccacatcccctgtgactcagcagactaagcttttaattatgttgtcttaagggtagtggtatgttagacgtcacttgaaatttgtagttaattgttcctacaccactaggaaacacgccatgcatataagtgaggagactagattagaagctaactccagtgccttttgtaaagtttacgtattttatggggtcttgggctatactttttcccaaaatatacacatacataatttctgtcttgtgttagctaacctaattatgtttctggattgtggagaggacagaatcaagtatagtaagggtgggacaggtgagtctaggggaaaaggatgatgatgagatttcatgtcgtcgtctgcatccttacaaaggtctcacagtagcctttctaagggaataattttgaaaccattgcaactgattgaagcacttatctattttccaagagggttaatagtaagggtggaggtcaaattactttgagcttgagccaagaggaataaatatagcatggaacccattactgtatttttttttttgaatgaggtatttgctttttgctttagtgacttaaaagccagaagagatggccgggcctggtggctcatgcctgtaatcccaggactttgggaggccgaggtgggcagatcacttgaggtcaggagttcgagaccagcctggccaacatggtgaaaccccatctctaccaaaaatacaaaaattagccgggtatggtggcaggcgcctgtaatcctagctactcgggaggctgaggcaggagagttgcttgaacctgggaggtggaggttgcagtgagccgagattgcgcccctgcacccagcttaggtgacagagcgagactctatctcaaaaataaaaaaattaaaaagccagagacgaatgcagttgtgactgttgtaattgggcaagcattcatttatgcagtaaaacagaagttagtaattcccctagaagtttagaggtctcaggctgggcgtggtggctcacgcctgtaattctagcactttgggaggccaagacgggcagatcacctgacgtcaggagttagagaccagcctggccaacatggtgaaaccccatctctactaaagatacaaaaatttggccgggcgcagtgtctcatgcctgtaatcccagcactttgggaggccgaggcaggcggatcacaaggtcaggagatcaagaccatcctgtctaacacggtgaaaccccgtctctactaaaaatacaaaaaaattggccgggcgtggtggctggcgcctgtagtcccagctacttgggaggctgaggcaggagaatggcgtaaacctgggaggcggagcttgcagtgagcctagatcatgccactgcactccagcctgggcgacagagtgagactctgtctcaaaaaaaaaaaaaaaaaaaaaaaagatacaaaaatttgctgggcatggtggtgggcgcctgtaatcctggatacttgggaggctgaggcaggagaattgcttgaacctgggaggaagaggttgcagtttgccgagatcgtgccactgctctccagcctgagagactccatctcaaaaaaaaaaaaaaaaaaaaaaaagagtgagactccatctcaaaaaaaaaaaaaaagtttggaggtcatattattatctgaaaatgggctgctgcaaatatttagcaagtgcctagtaagtgccaatgccagaccctattcttttctttcttttcttttttttctttttttatttttattttttatttttgagacagtctcactgtgttgcctaggctggagtgcagtggtgtgatttcggctcactgcaacctccgcctcccaggttcaagtgattctcctgtctcagcctcccactttcttttttttttttttgaaggtggagtctcactcttttgcccacgctgtagtacagtggtatgatcttaggtcactgcagcctctaactcctggtctcaagtgatctcctgcttcagcctcagaccctattctaagctgtctcattggttgatactctacaagaagcacagaataaacaagagagaaaaacaaatagaagtacaggtccattcagttaagttctttttactaaatacctggtagaagtgggacactttgccacaggatccagatcagtgattctaacccatgaaatcttgctgtgtttgttgttagttataaaacgaatgaattgtcactgaagtatcaaaaattaacagatgatttacttataaattaactagttaagatttagcatgatgactataatagtttttgcaaattatttacttttaaattaaccagttaagatttagtgtaatgcctatagtattttagctttaatgaatttgtgttctctatggtttcttgagcaggagagtcatagatctacagccattttagtttgggaaattgtgtgtgtctatggtttttcatatcatcaagtatgtattgtgatggaaactgatagagaattcattattctgggggttagagagatgaatgcgacatctgttctaggcccttccaggtctttctgtccagacgaatggatgagacttcagatacctatgatacaagaaagtaagatgatgtcatgacaaacttagaatgaaactatgagaatagagagaagaatgacagtgaaaatgtgtgcctgctacatagaaatggacctcttcaggttggcgtgtgcgagattttcttgctctagggagattgtttaagcaatcactatgtcgacaaacacagatgtttccctttctgaattcatatgatgaagatcagggatccaaacttattcaaaaagctaaagaggcaccattcgtacttgttggaatagaaggttttgcagcaattgttgcatatggattatacaaattgaagagcaggggaaatactaaaatgtcccttcatctgatccacatgggtgtggcagcccaaggctttgttgtaggagcaatgactgttgttatatcatgtatcgagaattctgggcaaaacctaagccttagaagaagagacgctgtcttgctcttgtaggaggagcttgttttagttagacgtctcattattgaagttacgtattattgttgaaaataaactaatttgtatgggtttagatggtaacacggcattttgaatattggcttcctttcttgcaggcttgatttgcctgttgactgaattactagtgactagtttactaactaggtcattcaaggaagtcaagttaacttaaaagaaacatgtcacctaaatgcacttgatggtgttgaatgtccaccttcttaaattgttaagatgaacttagttctaaggaagataacaggccaaccctgaagtactcccagtttgctgcagaatctcacatattttggatgttatagaagagtcctatttgccctagttaatttaactttttttttgcctgttttgtggactggctggctcttttagaactctgtccaaaaagtgcatggactataacttgtaaagcttcccacaactgacaatatatatatgtgcatgtatttaaaccaaatctggaaaacttacaatacagctgcataatggtagtatttattaaagaatcacaattgtaaacatgagaataacttatggattctagtttagttctttagtaattgcaaattatatttttgctgttgttatattagaataatttttgaatgtcatcttgaaatagaaatatgtattttaagcactcatgcaaaggtaaatgaacactgtttaaatgtgtgctttgcttattttttctgtaacaatcgtaaacattaaactgaacaaattacctacagtagttttgattaatgacctaagagcaagctggtttggccagacagtgtacccaaacttttatataccatcgaatgttattacacttgtgaaattctcctgtctaacctgaatttacattccatggtggttacatggtatatgtattattattaaagtaagtgagccatgtcaaaaaaaaaacaaaaaaacaaattgacctcttcaagaccagcctgggcaacatggtgaaaccccatctctccaaaaaaaaaaaaaaaaccctccaaaacaaaacagaataaaaccccaaaaaaccaaattagccgggtgtggtggcatgtgcgtgtaatcccagctacttgtgaggctgaggtgggagaatcgattgagcccaggaggtcaaagctataataagccatgatcatggcaacactgtgctccagagctgtgacagagtgagaccctgtgaaagaaggaaagaaagagagaaagagaaaggagagagagaaagaaattaattgacttcaactcacttactgagcctttaccatatgcctaggactgctaactgttgcgtatgcaaagatgagtgggcactcttggacttagtgttcattaactgctatttggatttgctatttgcctcttggggagaggtgatacttaggttggtgctttagcggcagggatggaagaaggcggtacttgcacgggaacctgaaggatgggcagcagttaggcatttgaaaatggaggcaaagcagctagcacagcatgaccatagggcgatttctgagactgtcaggtatgtgttttgaggtaattgcagacttcctgaagtgggttaaggtggggtaagttgctgccaaactgaggttggttgctttgaggaatttactgagaaactgaaaaatgcttcattttcaggatagggagatagcctgtgttggcaggattgctttccttccatttagctattttgtggccataaggtattttttctgcatatattttaaagaagtttttattttgaaataatttgttattaaaaatgttgttaaaaaatggtacaaagaatatacctttaaccaaattccccaattgctagcaatttaccatatttactttattattctactctttaaagtactttttctagatgggatgcggtggctcatgcctgtaattccagcactttgggaggctgacgcgggcagatcacttgaggtcaggagttcgagaccagcctggccaacatagtgaaaccctttctctacaaaaataaaaaaattagtcaggcgtgatggcacatgcttgtagtcctagctactcgagaggctgaggcaggagaatctcttgagctcgggaggcggagattgcagtgagccaagattgtgccactgtactccagcctaaatgacagagcgagactctgtctcaaagaaaacaaaaattaaaaatttttttttagaaagtactttttctgaattgtttaaaaataagttccagacctttatctctaaataccttttttttttttttttttttttctgagacggagtttctcgctcttgtcacccaggctggagtgtagtggtgcgatttctgctcactgcaaccttcgcctcctgggtttaagagattctcctgcctcagcctcctgagtagcttggattacaggcacgtgctaccatgcccgactaatttttgtatttttagtagaggctgggtttcaccatgttggccaggctagtcttgaactcctgacctcaggtgatccacccaccttggcctcacaaagtgctgggattataggcgtgagccaccgcacccggcctccctaagtactttttagaaaatcccatatttaattagctgggcatggtggtgtgcgcctgtaatcccagctacttgggaggctgaggtgggcgaattgcttgaacccaggaggtggaggttgcagtgagctgagatagcaccactgcactccagcctgggcgacagagcaagactctgtctaaaaaaaaaaaaaaaaagaaaaagaaaaaaatattccatatttcctaaagacaaggacattcttctacattaccacagtataattttcaaaatcaggaccttcttcagactttatcagtttttgcctttcaccccatttatggcagtcatcttgtttttattctatatgctttttttgggcaattgaaaaaatattcataaatttgaaaagaactccagaaatatacaaggataattcaactaacattcttgtctcccatagtcccatggcccactactgttagtatttggtcatgagggcctcagggccatacactggcctgcagggcccagcttcttctggccacctgttgcctcaccttcctattgattctgctgcagccacatggcctccttgctatcctgcaggcataacttacggattctagttgagttctttagtaattgcaaactatatttttgctgctgttatattagaataatttttaaatgtcatcttgaaatagaaatatttattttaagcactcatgcaaaggtaaatgaacactttttaaatgtgttcattgcttattttttccataagaattgtaaacattaaactgaacaaattacccataatggttttgattaatgacttaagagcaagctggtttggccagacagtgtacccaaacttttatataccatagaatgttattacacttgtgaaattctcttgtctaacctgaatttacattccatggtggttacatggtatatgtattgttacactcctacctctgggccttgttcaagcacacttttattgagtactttttatccccagccagagcaagtagatccattgggaacatatcagtaatgtgatgggtaatatttatttatgtattcattcatttatttgtttgagaagggttttgctctgtcatccaggctggagtgtaatggcatgatcatagctcactgcagcctcaacctcctgggcttaagccatctttccacctcagcctgctgagtagctaggactacagacatgtggcaccaagcctggctaatttttaaattttttgtggagacagggtctagatatattgaccatgctagtcttgaactctgggcctccgccttggcctcccaaagtggtgggattggaggtgtgagtcactatgcccagccctatcttctttcacaattacatataattaggccaggcacagtggctcaagtctgtaatcccagcacttttggaggccaaggcaggcagatcacctgaggtcaggagttggagaccagcctggacaacatggcaaaaccctgtttctactaaaaatacaaaagtttagccaggtgcggtggtgtgtgcctgtagtcccagctactcaggaggctgagagaggagaattgcttgagcgtgggaggcggaggttgcagtgagccaagatcacgttattgcactccagcctgggtgacagaacgacactctgtctcaaaaaaaaaaaaaaaagaaaaaagaaaaagaatataattagctaggcattgtggcacacgcctgtagtcccagctactcgggaggctgacatgggaggatctctctaagcccaggcattcggtgttgcagtgagctatgatcctaccactgcactccagccttgacaacagagtgagaccctgtctctggaaaaacaaaaacaaaaacaattacgtataatttatttcattgtatggatgttccataatttatttacctagcccctgctgaaagatatttaagttctttctaacttttccctattaattctccctgttttacagacaaagagcctaatatttggcatgaaggagtgagttagctagagtggcacacttcctaatggtcagtattgtagaggttggtaaaattaaattaaatttttgtttgagacagggtctcactctgtcatccaggctggaatgcagtggcgctgtcacggctcactgcagtgttgacttccagagcttcagtgatcctccccactgttcagcctcctaaatcattgggaccacaggcactcgccgtcactcctggctaatttttgtattttttgtagagacagggttttgccattttgcccaggctggtctcaaactcctgagctcaaccgatccacttgcctcggcttcccaaagtgctggaattacaggtgtgagccagtgtgtctggcccagagtctgtaactgttgttttcctgctgagtgcctaattccatctgataagatgctgggtgctatataaatcaagtgaaatgaacagagtccctgcctttaggggcattgcacagtatgtgatgcaaacttctgctctcggggcactcattaaagcagtgtgtacactcagagtaagaggcttagtagggtggctagatttggagggtggtgtgtggtacaagtgatgtcagtactccaggactgggtggtgccttttgaattctttgagttgtggaaaatgtcttgatctggaaactgaatggtgtttctggtgtttctttggaaacataggtttagtggtgtgagtacaggacgatccagaaagattgctgggggaaagggaggttgttgagaactcattcaccaggaatgtattaacgtaagtaagcggaaatagggcgggaccatgaccatcttcagaagcatccagccaggtccctggaagctgggatgctgcgttagtcactgtttagtgttgctttcctgagtcggtgccatagtcttgcgtttttaaaccgagatggagtcacaatctgagaaattggtgtgaaggaggctcatgggcagcaggaggaggaggagctgggagggcaacacatctagtctagggctagctgttccaacctaactctggcatttggggcagctctgccaccttgtggaatgagtgctcagtgatttctgtgggggctgagtgcagagatctgcattccaggggctagccttgaaatgttcaccaggactatatgtcggtgtggttcctttccttccacttgagtatttgtggcttcaaagtatttttcctacgtatgtagatgcatattttttcctgaatatatttttaggaagtttttattttgaaataatttagacttatacatctatgtagcatgggttaaaagaatgacaaaaaataatttcagatttataaaaaagttgcaaaaatagcaaaaagatttcccttatacctttccctatgttggaaaatatagattccccaattgctagcaatttaccatgttagctttattattctctcccagattttattttatttcattttttgagatggattctcactctttcgcccaagctggagtgcagtgatgagatcttggctcactgcaacctccacctcctgggttcaagcaattctcctgtctctgcctcccgagtagctggaattacaggcacacgccaccacgcctggctaattttttttgtacttttagtagagatggagtttcaccatgttggtcaagctggtctcgaactcctgacctcaagtgatctacccaccttggcctcccaaagtactgggattacaggcatgagccaccatgcccagccctctcccagattttttaatgtagtttttgaattgtttgaaaataaattgcagacctttagccctgaatatttcagtgtgtatttcctgaaaacaaggacatcctctttcattcccacaatataatcaaaatcaacaccttttaaaaactttgccatttgttctaataatgttctttgtggaaaaaatgggggtaaattttttttatttctggtcaagatccaatccagatacacacgttgaattcagctgtcatatttcttttgtcttctttaatctgaaacagaccttcagtcttctactttttttactggagtgggggacaggggaataagctttttttttttttttttttttttttttttttttactttttaaaaatgagatcttcagtttttgtcttttatgaccttgacattacatttctgaatatgatatccctcaatttgggtttttctgatgtatcctcataatttgatttgggttattcactttccacagaaataccacgtaagtgatgttgtgaccttttcaggtgcattctatcaggaagcacatgaaaacctgtttgtcccatttactggtgacattaacttttatcacttacctaaggtagtatctaccagctttttctactataaagctgttattaccccctttataatgaatacatttcttgtgagagaaacattgagactatgtaaatatcttatttcctcatcaaactttcacccattattttagcatctactggtatttcttgcctgaaacaatttttactgtgatggctgccaaatggtgatatctaactttcatcattctttcaacatgtattagtttatattctgccttaggggggtttaatctcacttctttccttcctttccttgtttgtttatctgcatgggctcatggattcttatgtcgttctatgggttataatctgtttctatcattatttattttaatgccaaaaaattataatcttgagattatgtcagtaaatactttttttttttttttttgagacagagtctcactctgttgcccaggctggagtgcactgatgagatctcagctcactgcaacctccgcctcctgggttcaagtgattctcctgcctcagcctcccaaatagctgggattacaggtgcccaccaccatgcccagctttttttttgtagctttagtagagactggtccaggctggtcttgaactcttgacctcaagtgatccgcctgcctcaccctcccaaagtgttgggattacaggtgtgagccactgtgcctggccttcgctaatctttgattgctttttgatgcttcaagctgaaaaaattattccttcatagacatgaaaaatattttattcattatattatgtgaaatatatatcaaaaaggtatcaaactgctgggccacatggcgtgattgccgacaagaatagcaactgtgttgggccttggtcctgagggaacacatgacaatgagaagtggctcttttcccctggctggagaagtgacaaataacaggatccaggagcagatgttaagtgctgatgatgaggtagagcagatagtcatttgtggcaggaattgatggcatgtggtccctgagagccagggccatctggatgtctttctgtttgtggagtgagctgggtctggatggaagtgaagacttggctgagccagggaggaatggcaggaagagggcacaggccaagcaggggtgtgaactgcgagagcatgaagcagttgctggagcaggagctgaggcctccttatggatgaatgggaggtgcgtttggaagcaagatgccactattggagtgacgtgggccttgaatgccagactgagcattgccagccagacggaatatcaccatcatcataatctaatcatagtcatccagttgtgaggtcatctgatactggcaatgggtacacaaaatattaaataggatatttatttctaagccaaatttcagaaaacaatttacaaactttttttaaagtataaacatagtgtatgcttactataaaaggaaaagtataaaacattactcaagtatatatagaaaatgagtgggctgctgatccccctctatattatctattgctgtgtgacagtattaccacaaatacagtagctgaaacaacacatttgttttctcacagtttctgtgggtgaggagttcaagcatagcttggtcctctgcaagcttacaatccaagggttggctcaggctgtattctcatctgagcactctactggggagggtttcaggcttacctgatggttggcggcattcagtccttctagactgtcagactgagggccttggtttttgctggtgcactcagttccttgcttcatatagagtagctcacaatgtagcagcttgtttcactaagacagcaaggaagagtgtttcctagtaagacagacactgtagtcttacctaatacaatcatgaaagtgacatactgtctccttcgccatattctgttagagacaggttacagctttgcccagtggcagtatcctagccaatgaggtttatctgaggcatgattattaaaataattgaaaattttcccaatacaccaaagtgacaacttacaacataggttggcaatggcaatttttgacatgtctacaaagactgaattaaaaaaaaaaaaaaaaaaaagaagaagttacaggttctgcccacactcaagaggaagagattatatcagggcgtgaataccaggaggcagggattattaggaaacattttagggtttaactccacaccctcccccgaaaatagataaagaaaacactgcttagggttaccttttttttttttttttttctgagacagagtttcgctcttgttgcccaggctggagtgcaatggtgcgatctcggcccaccgcaacctccgcctccctggttcaagcaattctcctgcttcagcctcctgagtagctgggattataggcttgcaccaccatgcccggctaattttgtattttttagtagaaatggggtttctccatgttggtcaggctggtctccaactcccgacctcaggtgacccacccaccttgacctctcaaagtgttgggattacaggtgtgagccaccacgcctggcctagggtaaccattattaaaagcaaaatttgtggaccatttttctctgcacataccaaagtatagtagtaatttaggaacaacaagagcaaagggtgactgttgagattttgagcctggatgcccaggagagagctctgtgctttttcttgattcctcctaacaataatttgttaaacaggagggagaggacagagcaggtaaatgataatatcagtaactacttggaaatagtgattttcatactgcttttaaaagaggaataaactggtttcagtagatgaccttatcccaagagtaattgagttccccctcacttttgaaccagcaactttaagatttaatttacaatattttcttctgggcatggtggctcatgcctgtaatcccagcactctgggaggctgaggcaggaagatcacttgagccaaggagttggagatcagccttgggcaacatagggagaccctcatctcttttttttttttttttaattaataatttacatgtcttctgccctctgtctctgagtaactgctctcatgttgacaagaaccatattagtatgctaagggtggatgatgtcacttagtggtgtcaccagctgctgccatgtatgttctaaatgaactgtcctcccataggggaatacatacctgtgtgtgagactgggatttatgtagactttggcccagcaggcccatttgacaaccagtggccctcttagtttctttttttttttttttttttttttttgaaatggagtctcgctgtgtcacctaggctggagtgcactggcacaatcttggcttactgcaccctctgcctctgggctcaagcgattctcctgcctcagcctcctgagtagctgggattataggtgcacaccaccacgctcagctaacttttgtatttttagtagagacggggttttgtcatgttagccaggctagtctcgaactcctgactttgtgattcgcccaccttgtcctcccaacgtgctgagattataggcgtgagccaccgtgcctggtgctatacataattttctattttgctcgtaatattttgggttttattttttatttttatttttattttgagacagagtctcactctgtcacccaggctggagtgcagtggcacaatctcagctcactgcaacctccacctcctgggttcgagcaatttttgtgcctcagcctcccgagtagctgggacaataggcacgcaccaccacgcccggataaatttttggatttttagtagagatagagtttcaccatgttggccaggctggtcttcaactcctgacctcaagtgatctgcccatctcagcctcctagagtgctgagattacacgcatgagccactgtgcttggccatattttgagttttatttcgcatagttataccatgcatattctgtttcttaattaattaattaattattttaaaattatttttgagacagggtctcactctgttgcttaggctggagtctcagtggtgcaatctcgtctcactgcaacctctgtccccaggttcaagtgattctctcaccttagcctcccaagtagctgggactagaagcatgcaccaccatgcctggctaatttttgtattttttggtagagacagggtttcctcatgttgtccaggctggtcttgaactcctgacctcaagtgatccacccaacttggcctcccaaagtgctgggattacaggcatgagccaccatccctggccctatttatttatttttgagacagttctgtctcactgttgcccaagctggagtgcagtggtaggatcatggctcactgcagcatcgacctcctgggttcagcctgtcctcctgcctcagtctcctgagtagccgagactatgggtgcatgccaccacacccatctactttttgtattttttcgtagagatgggggtctcactatgttgctcaggctggtcttaaactcctgggctcaagttatccacccaccttggcctcccaaagtgctggaattacaggcacgagccactacacctgacctattttaaaatgtaggatatttttgctgaatgcataattttaatgttcctattgtgattttattaattatcactaatccttcattgtttgattaataaaggagggcaattagatgttagaattttgcagattgtaccagtgacacatggtcccttggctagaattatgcataactttgattgttttgagcaaacaactgtgaggtcagtgacaacaataatgacaaataatattcaagtaacctcttgctgttaatactgggttttgtggccaggcacagtgcctcacgccttgtaatcccaacacttcaggaagccgaagtgggcagatcacctgaggtcaggagttcgagaccagcctggccaacagagtgaaaccccatctctactaaaaatacaaaataattagccaggcatggtggcacacatctctaatcctagctactcgggaggctgaggtaggagaatcacttgaacccggaggtggaggttgcagtgacccgagatcgttccactgcatttcagcctgggtgagagagtgagactctgtctcaaaaacaaaacaaacaacaataaaacaaaacaaaactaaacaaaactgggttttgtctttaactgcctcatggaaacatataggagagttgtgaaataagtattcttattcccatttaacaatgaggaaacagtcttggagaggctagctcccatgtttgatgtgacagtacactaacataagtaagagaagtaaagaatgcagcacattccaggccgggtacagtggctcatgcctgtaatcccagcactttgggaggccaaggtgggtggatcacttgcagtcaggagtttgagaccagcctgtcgtaaatgacgaaacccggtctgtactaaaaatacaaaaattagctgggcgtgatggcaggcgcctgtaatcccagctacttgggaggctgaggcagaagaatcgcttgaacccaggaggcggaggttgcagtgagctgagatcatgccactgcactccagcctgggcgacagagagagactctatgtcaaaaaaaaaaaaaaaaaggcagcacattgggtatttcaacattttagaaaaaggaataaacaaaaccaactgttatacaaatagaaagggaaggactacaggatccataaaatacttacaggaattcttcgaggcaggacagaatcttttctgctgagagaccggggtgaaggcattgtgcaaggaggtggtatttgaaggatgagcaagacttggtttgcatgtgggaacaacatgccaaatagagggaaccacatggcctagactggctgaactggcagcctttattgtgcatacagagggctccttttggctgtgcaaaaattaggataaggttgtgaagtctagaaaatataatttttcatgtctctaaatatttgggttcaaaagtaaaatagtccaatttgcaaaaccttcacgagaaagggacgattgcttaagtcttggtgtttatgtgtcttttttgttattctattttttatatattatttatttatttatgtactttttgagacagagtttgtcactgtgttgcccaggctggagtgcagtgggcaatcttggctcactgcaacctccgcctaccgggttcaagcgattcacctgcctcagcctcctgagaagctgggattacaggcatccgccaccacccccagctaattttttttgtttttttttgtttttttgttttttttaagcgggggacagtctcgttctttcgcccagtttcaagtacagtggcgtgatattggttcactgcaacctttgcctcccaggttcaagcgattctcctgcttcagcctcccgagtagatgggactacaggcatgcaccaccacgcctggctgattttttttttttttttttttttgtatttttagtagagacggggtttcaccatgttggtcaggctggtcttgaactcccgacctcaaatgatctgcccaccttggcctcccaaagtgctaggattacaggcgtgagccaccgcacccggccaattttgtatttttagtagagatggggtttcaccatgctgctcaggcaggtctcgaactcctgacctcaggtgctccacctgcctcagcctcccgaagtgttgggattacaggcatgagccaccacgtctggccttttttgttatattataatttaacatatcctaaacattttctcatcattaaaaagttaacataaacattttattcatatataatatttttatctacttttttttctttagagctctacttctggaagaatctactttttgatttgtggttctgaaattatagcaaattgtgtaatttatcatattttatcacaggctagtatgcattactgattcataccctgtttgcagcttttctcactctgatgcttgtgttgattgttttttccagcagtgcagggtagattatcaactggcttataatcagaagagcttgcttgtatcacagtgagttatacttcactgatttcactgggaaatcttacttcctgagtttccatggttaaagatttgtaatgctcaaatcttcttttgatgtttattccatcagagaaaacagaaactactttgtcttagtgttgccaaattgaaaagagcctttggtttggccaggatctttgtgatagtggcacctggcagtgtcttccctcctgaggagcatccgtgctcacttgagcctctctgatcctagtactgcctgtcagaggcagctggtccacctgagtgccaagctggcgctcctttggagtttcagctgtactaacttttgcttagctgtgaggaatcaaggattttgcttttgcagggggaatttttaacctgtaaactaaactcgcttgctttgaaaggtttactagattggcagattattagtctgattattagtccagtcatatctatctttcaacagatagtttggccatgacttttttttttttttgagatggagtttcgctcttgtcacccaggtcaatggtgtgatcttggctcattgcaacctccgccacctgggttcaagcaattcacctgcctcagcctcccaggtagctgggattacaggcacacgccaccacagctagctaatttttgtatttttagtagagacggggttttgccatgttggccaggcttgtcttgaactccttacctcaagtgattcacccacctcggtctcctaaagtactaggattacaggcatgagccaccactcccagccggccatggcttttttctttttttgttttcagacagagtttggctcttgttgcccaggctgcagtgcaatggtgtgatcgcagctcatttcaacctccacctagcaggttcaagtgattctcctgcctcagccccccgagtagctgggattacaggcacctgccaccacgcccagctaattttttgtatttttagtagagatggggtttcaccatgttggccaggctggtcttgaactcctgacctcaggtgatctgcctgccttggcttcccaaaatgctgggattacaggcatgagccactgtgccccgccaacatgtactgttatttatgttttaaaaagataaaacaatgttcagtattttggtggaacaagcttggtactatcctgcattgtatagagtattacaaaagaaaatctttaggtgtcatagtaaaagatgtcccaaaaggtggagataataatcacactgaaatgtgaatagtcatactaggaaccttgtggttggttttgaatttcacactttcaggaggacgtagacgaaatgaagtgctttcagggtgatatgcgtcccagccagggcatatgaagactggttgaagaaatgtttcacacttggttgataattataatagctgtctccagccatgttccagaaataacataagcctgcttatgatgtattttatatttgaaatgataatggcttccatgtgttgatcacctactttgtgccaagtacatacattatccataaccttttctccaaatctttgaaataggtggtattcttcccttaagaatctggataattagactagcttgcacagctaatttatgctgctaatgaaaggtagacctgggattaaatgttgtgctttttgtactataccatactgcctctggcatgagcatgcagtgaggctgtgggtggtggacacttcccctcttctgcttatgatcaggttaattcctgaaatttaaaatgacattgaatagtcatagtagataatattgagcacttatgtgccgtacacctttctaagctctttgcatgtaatttatttaattctcacaactcagcgaagttgttaccattatcgtctccatcctgcacatgaggaaactgaggcaaggggtgtaggtggaagaactcggttttgaaataggctgtccagctgcagaacccacacttagcccctgtactgtttgatttatgtagatgaccattgtgtatacacaagagtgcaagtttttgtttttgtttttgagacggagtctcactcttgtcacccaggctagagtgcaatggcacaatctcggctcactgcgatctcgacctcctggttcaagtgattctcctgcctcggcctcctgagtaagctggatctacaggcgcgcaccatgcccagctaatttttcttcttcttttttttttgagacaaagtctcgctctgtcgcccaggctggggtacagtggcgtgatcttgacccactgcaacctctgcctcctgggttcaagcaattcttccacctcagcttcccaagtagctgggactacaggcatgtgccaccatgcctggctaatttttataattttatttgagacaaggttttaccatgttggccaggctggtctcaaactcttgacctcaagtgatctgcccacctcagcctctcaaagtgctgggattacaggtgtgagccaccgtgccccgctaatttttgtattttagtagagatggggtttcgccatgttggccaggctggtcttgaactcctgactgcaagtgatctgcccgcctcagtttcccaaagtgctggaattatagtcgtgagccactgcacagggttccagccttagtcttttttagcctacaaaatggcaagtttatatgatttaacctaatatagatcaagggaaggatattccaaaataaactattttttgttttaggaaagaattggatgtattaaagttttgtgttttgaacttctccactgacatacttttcctgtccaattatttgtctgagaagtgtgtattctgtttcacatcgtgtcacttttgcttctccttttttttttttttttttttttgagacagagtttcactcttattgcccaagccagaatgcaatggcgcgatctcagctactgcaaccttcgcctcccaggttcaagtgattctcctgcctcagcctccggagttgctgggattatagatgcatgccaccacgcccagctaattttttatatttttagtggaaatggggtttcaccatgttagccaggctggtctggaattcccgacgtcatatgatccgcctgccttggtctcccaaagtgctaggattacaggcgtgagccatcgcgcctggccaactttttcttctcttacctgcaactaattgatctggcatcttttatatctcttgttataggtagaaagtgattttaaggcattatgctttgggatgtgtgtgtgtgtgtgtgtgtgtgtgtgtgtgtataggtttttgttggtttaaattggctctataacagcatccttcagacaaccaaacctaattttgaagtgtagagtataatttagatcaaatttaagagttttaaaattacctctgattatgggatgacacttgaaaaagtaatcataatacttaccaaaggtttaacaggctacctgcttccagtggagattgtgtgattgtgtttacgaaaaatctgattaactcaagaaagggccattcattgcataccgaattcctaattttttaaaaaaagatccatttaatataatatattcttgggtgaccaaatctgtagcataggaatgacttaatgtgattttttgttggtgggaagacattctaaagggagtcctcaataaactgcatttctaacacacaagaggttcttgtggcctgggggcggtggctcacacctgtaattccagcactctgggaggctgaggcaggcggatcacttgaagtcaggagttcgagaccaggctggaccagtctctactaaagctatgaaaaaaaaaaaactggacgtggtggtgggcatctgtaatcccagctactcaggaggctgaggctggagaatcgcttgaactggggaggtggaggttgcagtgagccgagatctcaccattgcactccagcctggacaaagagcaagactccgtctcaaaaaaaaaaaaaaaaaaaagtccttgtgatgggtttactttttgtcattggtgcctgaccgactattgccttctgcttatttgtcttttagggtcatgcttttattgtctctttgaaattgatcattgagtcctatgagtcctccttatgccttccacctccatttagttagctggtttttcttgcagtctctgggtcctttttgttgttgtttgttttgcatttattattattgttattcatacatttttgagacagggtcttactttgttgcccaggctggagtgcagtggtacagtcatggctcactgcagcctcaacctgctgggctcaagggatcctcccacctgagctttctgggtagctgggactataggcacatgccatcatgcctggctaattaacaaaatttttttttttgtagagatggggtcttgctgagttgtctacactggtcttgaggatcctggcctcaagtgatcctcttgccttggcctcatttattattatttttaattgacatgtaataattttacatattcatgtggtacagtgatatttccttacatgtatacgatgtataatgattaaatcaggataattggcaaatctgtcaccttgagcatttatttctttgtgttcagaacattcaaaatctgcttttctagctatttgaaaatatacaataaattgttattaattatagttcccccatagtgctgtagaatgctagaacttattcctcctattctggatccctttttttttttttttttttttttctgagacggggtcttgctctgtcgcccaggctcgagtgcagaggtgcgatctcggctcactgcaaactccgcctcctgggttcaagccattctcctgtttcagccttctgggtagctgggactacaggtgcccgacaccacgcccgactaattttgttgtatttttagtagagacagggtttcaccatgttagccaggatggtctcaatctcctgaccttgtgatctgcctgcctcggcctcctaaagtgctgggattacaggtgtgagccaccacgcccggtgttttttttttgttttgttttgttttttgagacagagtcttgctctgtcacccaggctgtagtgcggtggtgtgatcttggctcactgcaacctccgcctcccaggttcaagcgattcttctgcctcaacctcccgagtagctgggattacaggcatgtgccaccatgcccagctaatttttgtatttttagtagagatggggtttcaccatgttgtccaggctggtccgaactcctgacctcaggtgatccgcccacctcggcctcccaaagtgctgagattacaggcgtgagccactgcacccaccaaatctggatccttttgatcagacaaagtatattgtaaaacaaagtacgtgttgaaatctcaaagactcaatactaaaacctttgtaactgttacactttccttgcacaaaaactgacgtaaaatctcttaggtttcatagagagatactgaggaatgttccctatttccgtccacacagataggtaccaggatggtagtaaatgtaagtctgatccaactcataagtgctagcttgagatccttgattttatttattttatttattttttattttttttgagacagagtctggctctgttgaccagggtggagcacagtggcatgatctcagctcactgcaacttctgccttcgggttcaagcaattatcgtgcctcagcctcccgaatagctagaattacagatgtgctccaccatgcctggctaatttttttgtttgtttgttttttgtttgagtcaaagtcttgctcttgtctcccaggctggagtgcaatggcatgatctcgacttactgcaacctccgcctcccgggttcaagcaattctcctgcctcagcctcccaagtagctgggattacaggcacctgccatcatgcctggctaatttttgtatttttagtagagacagggtttcaccatattggccaggctggtctcgaactcctgacctcaggcgatctgcctcccttggcctcccaaagtgctgggattacaggtgtgaaccaccatgcccagcccatttcttttgtatttttaataaagatggggttttaccatgttggtcaggctggtcatgaactcctgatctcgagtgatccacctgccttggcctcccaaagtactaggattacaagtgtgagctgctctgcttgacctgagatcctttatttttatttttatttttatctttttaaggatttttccttaaagtatatgaaaccctgaaaacttgtacgactgtttaaaataaacatgttgatttcttcttcctaaagatgaatcacaattgagtcttatttgacctgaagttgttttcattctctctaaacagtaatttgaggaggtaatggcagtctgatgtctcaggctacatttgcacgctagtctttcaccctcagttgtcatgtgttaatgcatgttttgtaataactgggataaatacaaggaacctttgcttttgtttttatttttttcagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaagtaagtatcttcattcttcattgtgtcatggatggctcagttgcttggccacagtgcttgtgttttctgacacacaaagcaggcattaggtttgtctgttccagttgaatcccacaggactgaacatattaagtgatcctctgggctgtgccacggagctgtggccttcctacaggaagcaggaacacctaactgagaattaccttgaaaaatcgcttagcctctgaaggccttgctgcttccagtatgagtggggacagtcaagcaaagggaccttattcagaagccagcaggagaactcgtgctcagagcagcatgggtgccatcgtcccactctcccaaacctgtgcgttttccttgccagcagcacaaaagagcacgataaccaaaaggtgatatgtgattctactgctgggtccaaatgtgaatcctgtttcatcttaagtgcaactgaagatatttataatagcactgtttgttttgcatagaaaccataataggggttaccataaaatctcattttataacttattacagagaaccttttaggaaatatcttctaaagcttacagaaattgaaaaattacatgtttccaggggaatttcagaagaattaatggatttccaataaattatataatcttcccagctttttacttgctattgtaatatcactacctacttcttggcttagaggttttctattaaaatgtgtaggtcttaaatggtatatggaactcctaggacatctggcagtgttcccagtagagtatacaatcaggtttcaggacaggggcagagccatgcagactaaggtgaactctgaccctccgaggggtcaaccttcatttatgctgtcaagactttgtatgtgctgtattatccattaaaaatataatgtgaggccaggcacagtgtctcatgcctataattccagtgctttgggaggccaaggcaggaggatcacctgaggtcaggagttcgagaccagccttacttaacatggtgaaaccccgtctctactaaatatacaaaaaaattagccgggcttggtggtgcatgcctgtaatccgagctactctggaggttgaggcaggagaattgtttgaacccaggaggcagaggttgcagtgaaccgagatcatgccactgcactccagcctgggcgactgagtgagactccatctcaaaacaacaaccaaataagctagcataaactcatgcagattgtatggttctgcttatataaagttcaaaaatgagtaagaaaaataatctatggtatttgaggtcaggacagtagttacctttgggaggaggtgggtaggactggaaactgggcaggagggagtcttctagggctccgaaatgttctgtttcctgatctgcatggtggttatacaggtgtgttcatttatgaaaaagtattggtttatgtgtttatttgtgtgtacttttctgtgtatgttttatgcctcaataaaaagcatgcttaggcggacatagtggctcacacctgaaatcccagcactttgggaggtggatcgcctgaggtcaggagttcgagaccagcctggccaatatgatgaaaccccgtctctattaaaaatacaaaaattagccaggcgtggtggcaggtgcctgtaatcccagccactcaggaggctgaggcaggagaatcgcttgaacctaggaaacagaggttgcagtgagccaagatcgtgacactgcactccagcttggatgacagagcaaaactctgtctaaaaaaaaaaaaaaaaaaagtgtgcttaaaacatatacttggaaatggtaaaaatgcagtaagaatgtaagaaactgcagagagataccaagataaaggattgggctttttacttgaaataatgaatgtaattgagaggattttaatgtttgtttgtttccttttatctgacttacctccaaattaatctccttttcagtcccatggcactaatctaggtttcttctcttgccctggttgttgtggtcatttcttaatcagttttcctcccatcattctttactcactgtggttatccatcattttgccatcggatcgatctttaagagtacagacctgattatatcactctcttgctaaataatatgtaaggacagaatgatgcttctgcaaagcataagttttggagctgggcacatgggttgtgaatcccatctgttgcctcagtcactgttggactctcttcaggtctccagacctcactgtctctgagtgtaaacctgagttcttgtgattagtttgtgagctaatctttttaataagcctgtgtaaacctgagttcttgtgattagtttgtgagctaatctttttaataagcctgtttcaaggcctggtgtggggaagtggatttccttcttccccttgctttctagaatttcatccttctcatccagccatatgtggctgagttgggtacatttgtgtgagctctctagctggattctgagtgctgttggggaggaattatgttgagtcatcttgagtcactacagtatcccatgggctctgcagcactgtagaaacaaccagcactgaaggactggagattatgttgagtaaatggaggtcattgaggtgtcaggagccagtagaaatagcaggtgctggatatcgtaatggattgacatctgggcaggatgagggtacaacactggaagtagagtgcagcctaccccagacagcacaaagccaccagagttaggttgttccaaaggctaaggcttgacaggcaggaggccattgagggacccatggaagtcctgcttgcctgaccatcgtggtgtgtgctctctgtgctaggacatagtgcctctgcctctccctgttcatggtaattgtctgaggagggactttgctcagtataatgcacctgagcgtggggcaggtattcctggccagatgctgatctaccacctggctttgggattcttggttaactgtacttgcatgacttggtttatgttgagtaatatgtgtcagctcacctgagtttgaatacaggctctaccgcttgcttgctccaggaccttgggcagagaacttgcgaaacttcaattttcccatctgtgaaatagagataatagtactacctacctcataactttgttacactaaatgacccaaggggaaatgctttgtaaaatgtctggcctataataaactctgaatacacagtctctttatctcagtgaaagcatttacccaggcagtcagagatctgagttctgaactcagccaaccactgatgagctacaaaaccaatagacaagacattgccattttggtataattaagaagcctgagtgactgattttcttttcttttttctttttttttttttttgagtgattttcgtttcctttcctttcctttcctatcctttcttttttttttttttttttgagtaattgattttctactttcatgtctccctcttgggtctcatgcattatactgacctgggattttattctctctgttaatactgaaggatccttttcaatgggatttggaaatttcttggtgaattggagatttttgtttaccagtttttaaaaataaggcctgctgtatactcactagactagtagggttggacaattataaaatgctttaagggaaacaagagtcttttaaatccctatgctttaacttgttgccaaaaggttttttaagtccttatgttttaatttgtttaaagtggtcctttgtaaaattgatcaatttagcagcagaatgtgccacacagaccactcacccactgtttgatcatttctgtaccctctcagtgagggcacagtctgatcatttctgtaccctctcagtgagggcaggatttgtgcagccaggaaggaatgtacccccatccacatgtcaagtggacacagcctcctagacaacatggcgattacccaaatgtatctcccatgcctcattgctgatacgtttagcagttaccagaccgaaggaactagaccatccatcttgctgtgatccagatggaaaattgaaagcctggccaccagccctgactgtgccactaaccagcaagagcctcggtattatcatatgtggatggggctcagtagacatgttcagtgtttatcacgtagctggctatcaatgagagtgaacatagtagtgtatgctgaagattctgtagtgtggctgccttattctgctgcagctctccagaaggcacccctgttccaggcatcaccccttacctttctcccatcaaagccttgccccagtttgtcagggttttactggatacttgactaatctgataaccaaaaatttgaaagaatagaaccaacttaatagtattgtggtttcacctcaggcttctgagaatgctcttatcagggtggaatttcagacagtgtggggagttcagttggggagacgtttcactgggagacgtttcacagtgggactctgataccaggcagcctgtgttttagtttacaggcagtgtgaacttgacattctgcttaagtgaaaaacagaatattataggatttgtgctgcgtgataatagtaactgtaaaaaagtaccccctttatgctgaatgctctgatttttttttttttttttttttttttgagacagaatctcactctgttgcccagcctggagtgcagtggcgtgatcttggctcactgcaacctctgccttcggggttcaagcaattctcctgcctcagcctcccaaatagctggtattacaggcattcaccaccacacccagctaatttttgtatttttagtacagatggggttttgccatgttgtccaggctggtcttgaactcctggcctcaagtggtcccgaacttgggttctcatggatttctctgatggagattcctggggcttccagcaaaaccactgggactcgaaagtaccctgcagagatttcttggctttggactcctcaatatctgggttggtaaggttgggcagaagtagtagttctggtctgagagtccgtagactgatcttagtagcaacctgccactgttccctttgtgatctcaggcaggtctcttcacagatctgatttcttttctccttccttccttccttccttccttccttccttcctttcttttctttctttctctttctttttttttgtttgtttgagatgaagtttcactcttgttgcccaggctggagtgcaatagtgcgatcttggctcaccacaacctccgcctcccggattcaaatgattctcctgcctcagcctcccgagtagctgggattacaggcgtgcaccaccatgcctggctaattttgtatttttagtagagactgggcttctccgtgttggtcaggctggtctcaaactcccgacctcagatgatctgcctgccttggcctcccaaagtgctgggattacagagatgagccaccgtgcctggctgatctcctcatttctaaagtgatgatgtagagctaggtatgcatgagaccaggccctttcatgtggggagaaaagctcataaacaacgtgagaaagctaagttctgtgttaggaacatgtaaagtgctgtgggaacacagattcagattttgcctgtagggtaggagctggactgttgagaggagaaggtgacatttgagttaggccttgctgtgaattgaattgtgtcctgccttcctccctaaaattcatctgttgaagtcctaaccctcagtgtgatggtatttggcaataattaagtttaaatgatgtcatgaggttggggccttcatgatgggattagtggcattataggaagagatcagagctccccctatccccccatgtgaggatgtagcaagaagatggccatctgcaaactgggaagaggggcctcactgggaaccaaatagtctggcaccttgatcttgtagtttccaacctccagaactgtgagaaagaaatatctgttgtttaagccacatataacataatgttttgttataacagcctgagcagactaacccacgccttaaggagtgaggctagataggaattggaccagaagccgggaagaggaaaagcatccctgtgccaggaataggcatagcaagggttcagaggcatcaaggggaataaaccaatcatctgtccctaaggtgccccttctgatgccagccttctgtaatcctgtcactcatatggttcttctgctctcagccaagcctttagttgcaaaatgaatttagaaggtcagtttagatttgcttttccaaatgaggtttctcagtataccagagtcacttaataaattctcttccagtagccagctcaggctcccttgggtttctttctacttaggtgagttcagtcctgaatacaggttaggctcagaaagaattttctagtgtcaaagagggcctctcctgtgcttattattacttattgctacatctgtttgagtcgtgctctcaccctgggtaaacctcagttttaggccaaagtgagccttggggcactggagtgggcacctcttcattgccatccacaccttttctcatgggactacactggccttatcgcaggaacatgtcctcctccccttaaaacaaaaagagcagtgtgagcttaattagaatatggattatagtgccataacagagagaacaacatagctggctaaaatcagagaagtttatttccctctcaggatgaactgcaagttacccatggtggctgtgctcaggctctgaaggtccccgggccttgctttctccccattgttccaccaggctctaaaggtccctgggccttgctttctccccgtttttccaccaggatctgaaggtccctgggccttgctttctccccgttgttccaccaggctctgaaggttcctgggccttgctttctccccgttgttgccccaggtgctgctcttctttggtgtccaaaatggctccctgccttgcttatctttcagctgctgggaagggaagtgaagggaaagtatgctcctttcttttaaggcacaacccagaagtgccacacatcacttcttgtatccgataggcagaacatctgccacccctctctcaagggaacatggaacatgaactcttcctatggaagaagtggagaaatagtgttgggaagggcactgcagcctttaccacatgagctaagaagaatgcagggcttgaggagggaggggttattggagggccatcctgggttggtatctgggtgggactcatggtaggggactgataggagatgagattgggaaggtagacatggtgaaatgacagtggcagaccctgactaccacttctctgataggcagagagaacccctccaagcccatatctgcttctgtctgcccttgagctaccacccccttgtgcagatcagaacatgctctggtcagtgcttgtcccagcctcgtggctgagctctgtggtgtacaagcagttaccccataggtggtggtgatgctattcttttccctcctggaagcggcggtctgatgacagttgtccctctgctctcataaatcagtgactggatggaatactcaagagtcagctgtatggaggagcaagagggcctctggtatttctcctgatggacacctgcagcttggggagaggacaagtggccatcctggaggaaagcctcaccctgcttaggtgacaagctgctctctgatccagagcctggcaggaagtcactctttgtccaacctagtcagggcagccgggaggaagctccacagccagtacatgctctgtgggtcatggaacaattggtaaagctgtccagagagagagttgacagcagaccagcgaccagcactgctttccagggaaagaatattgcaagcaagataataacagctgacatttgagtacttcatgtgctgggcgctgttccaagttcgttacttgtattgtcttatttagttatcagaacaaaccctctgaggtgggtgctgttatgcctaatttatgcagttattccactgtggtctcagagtgtggttgatatgatttcaatgatttgaattcactgatacttggtttatggccaagcatgtggtcaattttagattatttgccatttgcagatgggtggaatgtatagtttgtcattgctggatttaagtccagtatttctttgttttttgcctcgatgatctttctaatgctgtgtcagaggggtgttgaagtcccccactaaaattatgtgactaagtctttctttaggtctggaagtacttgttttaagaatttggatgctctaatgttggcatattaggcatctataatgcctaatttatagattagaaactaaggtgcagatgagatggattaatttgaaccaatatttacagctctagcaggtggtggagccatgatttgaatctgttgtgaagcccatactctcactttgaggctctgctgtcttttatgattccagggaagagtgcctgtcccaggccctggagtgggagataggagtgcctccctgcaggagacttcctgtgcacctggcagtctggggatttctgcctgttgtcaccttgtctactcctgttcctcagggactcacctgccttagctcagtccttgctgggcaattctctgtgtcttttctagggcctgcaagttctgccactggagtttacaaatgaccactatctttagccagataaccaggtatgccctagcattgggcagttttcctctacatcttgccctctctgtctcaaggatttaggacctagattatgttgctgcttcaggcagttctgctgctgacaagataaattctgttagcatttcactaagctgatgggtataattactttagttggaggtcactaaaacctgaatttacaaataaaaactggatcagggagcagtctgtgtgtgtgttgtggaggagtgtgggtgaaggtacaacagataatatccctcctttgctgagatccttccagtggctccctaaatcactcatagtaaaagccaacttcctcacagggcccttcatcatgttctgctgctagcctccatctgcttctttcccttactcaacctaattctaatttcagttccattggagccatacagatctccttgctatttctttatttcaaattccagttattcattgctggcatatagaaaagcaatagattgttgtatattaactttgtgtcttgtaaccttgctgtaagtgctgttctggcagtctttgttttgatcaattctttgggatattctacatagacagatcatctgcaaacaaagatagtgttatttcttccatttcaatctgtagagcttttatttccttttctggcttattccactcgctaagatttccagtaaaatgttgaataggagtagagagagaggcaccttgctttgttcctgatcttaaggggaaagcatccaatttcttaccattaagtatgaagttggctgcaaagaagttctttatccagttgaggaaattccctcctattcatagtttgctgccccatcagctttttaggttggtgcaaaagtaattgtggtttttgctgtgactttcagtggcaaaaacagcaattcttttgcaccaactgaatagaatgtagctctgtgagggacagggggtgttatctgtctttgttcattgcaatatccctcctccctagaatgtgcctggaacatagtatatgcatggtatctgttgcctaaatgaattgaaaccatggctaataatacggtggtagtcaaactgtgtaaaaatgagttttgtttttatgtttggggaagaccctgttctcaggatcaatgaaaagtaaaaatgactgatagcttttttgaaattcagaaggcatctgaccatgttttgccagtctgctgtctttgggccttgggtttttggttttaaaaatgagtgcttttacaaattggtctaagttctctccagctttcatgtttgttgactttctttctagttgcagggtattttaaaagttaaggagctcaaatacccttaagtcctatgttctctagccagtagatcaactctgcctatagattccaggcttgccagccagtaggcacagcccactcttcctttctgatggttaccaagtgctaatttgggagaggggcctgggttgcagaggagacatggtgctggagagtcagaccaatttgcttttaaatacctatgtgatgtcaggtgggtgatttcacctctctgagcttcagtttcccggcctgtaaaatgggaatgatatacacacaagttgttgtaaggattaaatgagatatttgtggtttccttgcacacaagtgcttagttaaaatggaatctgattgtctaccctgcctcacacctgctttgtggatatcttgattccatatcagaatcacttggaaagttttaaaaatcctgatatccttgaaaacatcatgctaaatgaaagaaaccagacacaaaaggtcacatattgtatggttccatatttatgagatatccagagtagataagcccatggagtcagatgcaggttggtggggctgaggggaagggcttaggggaggggaaatgctgcttaatggtaaagggttttactttggagtgatggaaatgttcttagaactatatcaaagtggtcgtacaacattgtgaatgtactaaatgcaactgaattggttgtttttctttacagctgtatcgagacttaattgtacaatgaactacacatatttaaatggtataattggtgagatttgacatatgtttatacccaactatcaccacaatcaagatagtaaacatattccattccctcccaaactttcctcatgcccctttttagttcctccttcccacctctcccctccccctgagctccaggcaaccactattctgcttactgttacttgtggtgtgttttctctcttttttcttcccccccgagatggagtcgctgtgttgcccaggctggagtgaagtggcacgatctcaactcactacaacctctgcctcctgggctcaagcgattctcctgcctcagcctcccaagtagctgggattacaggcatgagccaccacacccagctaatttttgtatttttagtacagatggggttttatcgtattggtcatgctggtcttgaactcctgaccccagctgatctgcctaccttggcctcccaaagtgctgggagtgagccagcatgcccagatggtttgttttcattttgcagactattgtagaaatggaatcctgcagtgcgcacttgttttgtctggctcctttcacccagcatactttgagattcacttatgttgctgttcgtacctttttttctatttttattttttgagacggagtcttgcactgtcgcccaggctggagtgcagtggccagacctcagctcactgcaagctccgcctcctgggttcacgccattctcctgcctcagcctccccagtagctgggactacaggcgcccgctaccacgcccggctaattttttctgtatttttagtagagacagggttttaccatgttagccaggatggtctcaatctcctgacctcgtgatccgcccgccttggcctcccaaagtgctgggattaccggcatgagccactgcgcccggcctgctgttcctacctttattgctgaaaagtcttccattgtgtggatacatcatgaattatttgtacattcacttgatggacatttgggcagttttcagtttggggcgattacaactaaaactgctatgagtcttcatgtataagtctctatgtggacgtaagtgatgctttctcttgaatgaatatgttgtagtggatggcaaggtcataggatatatgtacgtataaactcttgttgatatctaaaaagtaaggcatggtgaattacttgaaatcctataaatatatttggtaagagaagaagaaacgactggatttttttgtttgtttgttttggagacagattcccactctgtcacccaggctggagtgcaatggtgcgatctgggctcactgcaacctccgcctccccgattcgagcaattcttctgcctcagcctcccaagtagctgggattacaggcatctgccaccacgcctgactaatttttatatttttagtagagacggggttttgccatgtgggccaggctgatctcaagctcctgacctcaggtgattcacctgccttggcctcccaaagtgctgggattacaggcatgagccaccgtgcccggctacgactgaatttttctttctttcttttttttttttttctttgagatggagtctcgctctgtcgccaggctggagtgcaatgacatgatctcggctcactgcagcctccgcctcccgtgttcaagcgattctcctgcctcagcctcctgagtagctgggattacaggcacacaccaccagacccagctaatttttgtatttttagagagacggggtttcaccatgttggtcaggctggtcttgaactcctgaccttgtgatctgcccgcctgggcctcccaaagtgctgggattacaggcgtgagccaccgcacccagcaatgactggatttttcaatggtgaagctattaattttgaaaactgatctcagtagagtggtaggtgggaagctttttagaatgtaattaggaaaaactgtgaagggagaagtttggacagggaggattgacatcttaaggagttttgttgtagagtagagaggataaagttttggtatttagaaggcatgaactgttcatttaaaaataattttatgttatatgaatggtacctcaatttttagaaaaagaatgaaacaagcaacagaatcctggctggatgcggtggctcacacctataatcccagcactttgggaagctgaggcggctggatcacctgaggtcaggagttcaagaccagcctggccgaaatagtgaaaccccatctctactaaaaatacaaaatttagccaggtgtggtggcgtgtgtctgtagtcccagctactctggaggctgaggcaggagaatcgcttgaacccgggaggcggaggttgcagtgagctgagatcgcgccactgcactccagcctgggtgacatggcgatgaaaacaacaaaaatcagatccccaggtgattccagtatgtagccagggttgaggagcagtgatctaagtagagttttgcaaacttgtctgtaaagggccagataataaatacttttcaaccttggggttgaaaggtctctgtcctcacttttcagctctgctgttgaagtgtgaaagacacgtaaccaatgaacatggcatgtttcactaaaatccatttacaatgacgggccatgggccagagtgtgctgagctggactgaaaggctaagtgatggaggcgtggctctgcctccagactggagcaatctgctccagacttcccaggcagagccagacccatcggacatgcttgcttaggagaagaataagcaccccagcattgaaaacaaaatgttaaaatgccaacatttgtgtttaattctagctacaaaagacaaggaaaagaataaagagaagaaattcaaggagtttgtgagagtgaagccaaagaagaaaaagaaaaagaaaaagaaaaccaaacctggtaattttttttcctgagggtttcacttaggtttccttactatgaatggggaggggttgctttctcccattatggcctctgggcctgcgctgagcagaggaaggaccaatagtctcttaccagggcttgtgggctcaacctagtatgggccctggaaggggaggcatccactcacccaggtgttacaaagtcctgctggcattgaaaagccttctcacttgctgccttggccagtgtgccctgctgcaggatggtacagatgaaggcatcgaagtgtaagcagatgtgcaggtgaatgatggtatttgttcacacacacgactcttaaaacacatctttgagccctcttgagaaaggattcccttcttaaaaactgtgtctagccctcacaaaaatgtttagaaaaatctatatattctgacttgggacttaaaggatgccacgttttattcttggtgtatcttctagcttagaaaaacaatcttatcagaaaaagaggagagggtcaatacttaagaggaggtgtttgggccccttcatctgctctccacacctctttttggttgaattgtccctgagcctttgtgctgcttgaaaaggaggcttgttggttggatgagattgattctagaatgcaccagtgttaactagggttattcattccttcctgatcctgttcttccagaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattgggtaaggaggctcttctgtcctgatcatttgctgatcatttattggaaaatacaagcatacctgggagatattatgggtttggttctaggccactacaataaaacaaataaagctagtcagacataatttttattttcccagtgtttacaaaacttatgtttatactatattgtagtctcttaagtgttcagtagcatatgtctaaaacaatgcatataccttaattggaaaatattgttgtgttgagaaatgtcaagttttttggagtaagtcctcaaaagcatagacaataaataaagaaatggacaagtgggattgcatcaagctgaaaagcttatgcacagcaaactaaacgattaatagaatgaaccgaaaacctactgaatgaaagaaaatatttgtaaactattcatcaacaagagattagtagctggaatatataagaactcaactcaatagaaaaattattcaatgtaaaaattggtggccaggcgcggtggctcacacttgtaatccctacactttgtgaggtgaggcaggtgggtcacttgagcccagaagtttgagaccagcctggccaacatggtgaaacccatctctgcaaaaatacaaaaacttagccaggcgtggtggtgtctgccttgtaatcccagctactcgggaggttgaggcaggagaatcgtttgaatctgggaggcagaggttgcagcgagccaagatcatgccacttcactccagcctgggtgacaaagccagactccgtctcaaaaaaaaaaaaaaaacagtaaaatatgttatatatatacatatacatatatatatgtatatatgtaaaaaaaaaggtaaaatgttttatatatatatatatagatatacacacacttacacacatatatatatgtgctcaacctaatatgggccctggaagggaggcacccactcacccaggtgttacaaagtcctgctggcattgaaaagccttctcacttgctgcattggccagtgtgtcctgctacaggatggtacatatgaaggcattgaagtgtaagtggatgtgcaggtgaatgatggtatttgttcacacacacgactcttaaaacatatctttgagccctcttgagaaagggtttatatatataatttatattttaaaatatatatatatattttgttttgttttgttttgttttgctttgtttttgtttttgagacagagtctcactctgttgcccaggctggagtgcagtggcgcgatcttggctcactgcaacctctgcctcctggattcaagcaattctcctgtctcaacctcccaagttgctgggattacaggtgtacgccaccacgcctggctaatttttgtatttttagtatacacagggtttcaccatgttggtcaggctggtcttgaactcctgaccttgtgatccacccacttcgacctcccaaagtgctgggattacaggcatgagccaccgtgcctggactgttacatttcttaaaactttctttgaaataaaattagtttagttattccatatgtcctgaaaaatgtgacatatgtgttcattagatcaatcttgttttgatgtaatgttcaaaaatttgaactagcaatacatttcattatgttaactgacaatttaaaaaatgaaagctgggtgcaatgtcccacacctgtaatcccaacactctgggaggctgaggcgggtggattgcttgaccccagaagttcaagaccagcctgggcaacatggcaaaccttgcctctacaaaaaatacaaaaaaagttagccggttgttgtggcatgcacctgtaatctcagctacttaggaggctcaggtgggaggaacacctcagcccaggaggtcaaggctgcagtgagctgtgatcatgccactgcactctgggagaaagaatgagaccctgtctcaaaaataagtaaataaaataaaaataataaaaagtaaaacaatattttattgcttaaaaatgctgacagacacaaagtatttgcttttgcaataatggtgtcagtagactttcagggttgctgccacacaccttcaatttgtaaaataatatacaatatctgtgaagtgcaataaaatattaatagttatgcctgacttagaacagtatctgcttcagaacaagcgcttagtaaaagttagctgtgattataactaatcaggcatcaagtgattctgcctctgattatccctggaatcttcctcttcctcattcctcactgtctatagagtttttgtttttgatttttgtttttgagacggagtctcactctgtcacccaggctggagtgcagtggcgtgatcttggctcactgcaacctctgcctcctgggttcaagtgattctcctgcctcagcctccccatagctgggattacaggcgcacaccaccacacctagctaatttttttgtatttttagtagagacagggtttcaccacgttggccaggctggtctcaaatcctaggctcaagtgatcggcccaccttggcctcctaaagtgctgggattacaggcgtgagccactgtgcccagcctgtttgtcttttgagacaaagtctcacgctgtcacccaggatggagtgcagtggtgtgatcatagctcactgcagcctcaaactcgcaggctcaagggatcctcctgcctcagcctcctcagtagctgggactgtagacgtgcatcaccgtgcccagctaattttttttttcttttagtggagatggggttttgccatgttgcccaggcttgacttgaactcttgagtgcaagcaatcctcctccttcggcctcccaaaatgctggtattagaggcatgaaccaccatgctcagcctttgtttacagagttttaaaggtagctctggatacagacagactgtaagccaggtcctgactggatggagtgaggctgaagaacatgttagagttgtcagggatggtggcctgtgtggttcatggggagttgtagctcctctgccactgagttctatgatcttgagtagccactgccgttgggcttcattctctcagtgaaatgaggaagtggagttgagttcactgccaggcagcatgcttcgtttgggctgttactaaatgacagatccaaggacagattggcatcctcgtttccttgccctatgaatgttcttgtttggaggtatgggactataatgtcatttttcattcttgacaatcaaaggttttttaattttataacctaaaatagtaactgttgttttccctttcctcgtagaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcaggtaggcagagcttccaggaaacaggtctagagaagcacaaactggtccttggagggaattttgaggccagcaacaatggcaagtcatagcagagccccagaaacacagcacgaacggcagcagactgagcttctctttttcgtttggcttcctcagagttccaggctgccatacatagtccattgatggagtaagagaggactttagggatcactgagtctaaacctctcatgctctgcttgaggcagctgggacccgcaaatgggaagggccttgcctgtggtcacaaagtgaggagttgaacagcagggactgaaatctttggagtggcagtttaatcttcccatggactcttatcttctctttgaggtaaattttctttaagatccaaagtcatgcaggctggctttataacttctatgtttctttttctttattttcctgacatttgagtctgtcatcttcatctctgagatgtgcctgtggtgggtgggacctccttacctgcttggggaaaccatgcctggccagcacctgcctgccctgtcccttgtctgtaaattgcagttctgggagaggtggcgctggctggctggctcctaagggtgtcacaagttccctgggtgtcttgacagctgcccaactggcttgggaagctgagtttttaaaagtcatggttatattggttaggatttttttttaggggcaagtacaaatattgttgggaaaatagactgggtcctagggctcagaggcagggctgctttcaggctcagaacctggaattccatcttgagggccttggtctgccttgtttcctgcttctctggagtccttttggttcttttttattttattccttgcttattttcttggaaaatgcaaaatggccacctttggcctcgccccaattttacatttttgtgttcaagaggctaggtagaccaaggtcagaatcttagtcccagttctaaatttctgagtaagtaattccagccaaatttagatcagatattagtttttggaacagtcacctgtggccagaggggaaagaggtttgttatggatcaaatgctctcccctggtctagttgtctgatctggtggtagtagagcttacagattatcgacaggggcaaaaagactgcctggggcccacctgtgttatattatagcgttaatgggggttcagggattgttcccagtaaagggggtggctgcccattgtccaataagaatctgtatagcctattgagattatgagaaacaggcccagcccctttggcttgctttctgtgatagaatattatttccttgccctttcagtactgtaggttggcatggcatgggtttggttttttttttctttttgagacggagttttgcacttgtttcccaggctggagtgcaatggcgcgatttcggctcaccaccaccctctgcctcccaggttcaagcgattcgcctgcctccactgcccgagtagctgggattacaggcatgtgctaccacgcccggctaatttttgtattttcagtagagaagcggtttctccatgttggtcaggcttgtctggaactcccgacctcaggtgatccacctgccttggcctcccaaagtattgggattacaggcgtgagccaccgcgcctggcaaaatatttttgttatggtaatttttttttttttttttttttgagacggagtctccctctgtcacccaggctggagtgcaatggcgcaatctcggctcactgcaacctctgcctcccgggttcaagcgattctcctgcctcagccccctgagtagctgggactataggcgcctgccaccatgcccggctaatttttgtatttttagtagagacggtgtttcaccatattggctaggctggtcttgaactcttgaccttgtgatctgcatggcatggatttttgaaattcacttttggatcttgacttaatatacagttacattttttcctctcatctttgaatttgttgtctttatactcaacaatcccctttccttttatttcttgaaacattgggacttttccgtagctctttaaactttcagaacaactagagatgagtagatgtatttgcttttttgccttttattttcccagggcttttagaaaacacttttattttgaaataattatagattcacaggagattgtaaagaggtgtacaggagagtcccatgaattcctctgctggtcttcctcccatggcaaaagcccataaacccacagtaggatatcaaaactacaaaaccatttgacattggcataatcactagagcttattcagattttatcagtgatatacacatactcatttgtgtgtgcatatagctctgtgtgctttcattacaagtacagccttgtgtaatcactcccgcaatcaaggtactgaggtatactaagaccatgagattccctcctggtacccatactttgtagccatacttatccctaaccctggaaacactaaactgtttcaactgtctataattatgtaatttatgattcttggttaatggaatcacgtggtatgtatctttttgagagaggccttttttactctgtataatatccttgagattcatccatgttgttgtgtgtttcagtagtcatttattcttattgtccggtagtattccatgctatggatgtaccacagtcgtgctctttttgttaatagaactaaagcaactctatggagctaaggtaactgggtacagctgagtagtgatttaaagtttctggagtgttttcagaaataccatctcacctctaacaaggcgatctcaagtcacttatttgggaaaacaaaattacgaagatatgatttctttcattgttgtagaaccattaaataagtcatcagattatgatttgaacccagggcacccagtcaagtgctctttccctatgcggccttagctacggggatttacatttacagttgagaagtgaaacaagaaaaatttgtttttgaaacataatagtaccatctagcctggctgaccaacccttccccagcaccaccagtggacatgcgcatgtacatacacacatacatacccacactttaggctgagggagagtcttgtctttttgaatagccttcatagtaacctctgggattcaagggtacctgatatttaagacctttattaaaccttggttcagtggttttcaaacatttttgaatatcagaaccccttttcctaatggactgtttcatagaaccccaaaatgtgtaacaggtaacagcaatagttttgaaagttcaaaatggataatctttacttgtgaggtcggacatgtgaatggtgggcatattcccatgattctaatatgctgtcagaattatgagtgacagacagttgctgacttggagcacttcagtggctcatttgtttttctctatttggttatacaacagtgagacaagcgtgatgcacatggccattgtcagggtgacttttcctgaacagcatgctgtgtagttactttgattaatcagagatgggaggacaagctccgttttgaggtcaacataatactgagctatcctagcaatacaaaattatgtgtggtggcgggcttcattgtcttaacatatggcttggaacatgtttgagtgtgcatctttttttttttaattgtcctaccttaaaaacacacacattttgcagactctctgaagccctgtggactactattagataattgttggttgggcatgctgtaatcccagaattttgggaggcagaggcgggaggattgcttgagcccaggagttcgagaccagccctggaaacatagcaagatcctacctctacaaaaaaattaaaaaattagctgggcatggtgatgcatgccagcagacccaactactccagagactgaagtaggatgatcacttgagcctgggagttcaaggctgcagcgagccctggttattctgttgcactccagcctgggtgacagaatgagaccctgtccccaccctcccccccaaaaaaaagaaaagaaaaaaaatgttatataacatgaagactatcattttttagtagattttttttaagtttgtttttaaaaggatgttgaagatctttagtttctactctgtcatccttgagcatatgctcagttccaggccttgttagtctgacagatttgccctttatctgcctgttaaaatcttcagtgggtgagtaatgaatgtccctcctggcagggctattctgtctaacagtatgtaacccatttctgatccactctggtactttctctattgacttttctataagtagcaaggatcttggtgtgtttgagggtagaggttaatatgccattatgtgctatatgaagaaactaatttcggggcaattggggccaccatgagcatggcagagtcaggagccaacttgatctcctgcttcccaggctccacaagaccttgtgtctcaagctcacttcagagcttcttggcttttgttccagaggacttttctgtgctgtccacctgaaccaagagtgcccacctggctttgtgttaaggagggacggtttctgactgtcctgtcactgtgagcaacgtaccttttctactcaataactttatcaaaaggcataagtttagagggagctagctagaacaaatacagtttaaacttttaaaatgtattcaccatctaattaggaagacaggaataaatttttcttaaatctttaccttaaattgatattttgaataaccctagaatacatttagagtgtgttttctagaagtgcatgtattactatagagaaataactttttggatcattgtcattatatgagtagtatcaacattgttcatgtatatcactattttatcttatttaccagtgctaatttaaatcactggaaggttaaaatcctacttaataaatacggtatttgagaaatctggctaccacataaaaatgaacaggaaatacatttgatatttaaattattttaatcgctgtagagcatgttttgttaagctttttcttaaatggctagataataaatttttaggttttgagggccatatggccttgttgcacctactggattcttctttgagcagctgtaggcaatatgtaaaacaaattttcacctgtatggttggctgcagtggctcacatctgtaatactagcactttgggaggctgaggtgggcagatcactttaggccaggagttcaagaccagcctgggcaacgtggcaaaccctgtctctacaaaaaatacaaaaattagttaattgtgatggtgcacacttgtagtcccagcttctcaggaggctgaggtgggtggatcacttaagcctgggcagtcaaggctgcagggagatgagattgtaccactgcactacaacctgttcaatagagtgagaccctgtctcaaaaaacaaacaaacaaaaacccctaaacaaatgcgtatggctgtgttcacataatactttatttacaaaacaagtcaagctggcattggcacatgggctgtagtttgctgacctttgccctacaacaacaagtattaatatgtattaagtgtccaactccagtaaagattttatagcagttttaaaaagaagcccattttaatggcctagcactgtggctcacacccgtaatcctagcactttggaaggctgaagcggaaggatcacttgagtccaggagttcaaaaccagcttgggcaacatagagagaccccgtttctacaagaaattaaataaaaattaagtaaataaaaatttaaacaaagaagcccatttgaaagttttggttattttaaaattcatattatttgttggtacctaatgcactgacataattcaaagtccagaaagcacacagagaaataccttatccccaccttatccccaactacccattccgtagagtcagcccttatcagtttcttgtatatccttccagaaacattctatggctaaacaaacaatagcaaatgtattgtttccttttaaaaattttttggtaaaatacacataacattaaaagttaccctttttatttttatattttcctattttgagacaggatcttgctttgtcacccaggatggagtacagaggcacaatcacagctcatggcagcctccagctcctgggctcaagtgattgttccacctcagccttctaagtagctgagactacatgcacacaacatcacaccttgctaatttctttaatttttttttgtagagatggaatcttgctatgtttttcaggctggtctcaaactcctggcctcaaatgacccttcctcctcagcctcccaaagtgctaggattacaggtgtgagccaccctgccctgcctaaaagttaccattataaccatttttaagtatgcaagtcagtgatgttaagtacattcacattgctttgcaaccatctctttgtctaaatgcaaatgtttgcattttatgtatagtattttcttttcttttcttttcttttttttttttttttgcgatggagttttgctcttgtcgcccaggctggggtagtgcaatggtgtgatctcggctcactacaacctccacctcccaggttcaagtgattctcctgcctcagcctcccgagtagctgggattacaggcatgcaccaccacgcttggctaattttgtatttttagtagaggcagggtttctccatgttggtcaggctggtcttgaattcccgacctcaggtgatccgcccacctcggcctcccaaagttctggaattacaggcataaaccactgtgcctggccgcatgtatagtatttttaacatcttttttcatttagcaatatgtaaattaaaaaccattttattttctgcataatggttggatcacattttattttactttattttattttatttttttgacggagattcgctctgtcacccaggctggagtgcagtggcatgatcttggttcactgcaaccttcctctcctgggttcaagtgatcctcctgcctcagcctcctgagtagctgggactacaggtgtgtaccaccacacctggctaattttttgtattgttagtagagatgaggtctcaccatgttggccaggctgacctcaggtgaccaactcctgacttcaggatatcctcccgcctcggcctcccaaagtgcggggattatagacaagagccactgcgcctggcccatttttcttttttttaagctatataaatatttgatccacctgaaattttgccaggtatatagtgagaactatggctccccattgtactaataccatacctcactgtttgaaatgccacctttatttacttcatttctaaatgcatttgaatccttttctggttctctctttcagcgattcatctgtctgtatatttgctcgtacaattctattttaattattgtacctttataatatttttaaaatatctggtatggctagtgtctccatattgctctttctttttcacacatttcccagctgttaattttagaattttttctagttctgaagctattaatttattattttattgagactttttttttttttttctgatatggaatctcgctctgttgcccaggctggagtgtagtagcgtgatcttggctcactgcaacctccgcctcctaggttcaagcaattttgaacctgcttcagcctcccaagtagctgagattacaggcgcctgccaccatgcctccctaatttttgtatttttagtggagatggggtttcaaacatgttggccaggctgatcttgaacttctgaccttaagtgatccccccgcctcggcctcccaaagtgctggctgggattacaggcatgagccactgtgcttggccgggactacattctttttataaattaacccaaggataattgatatccatatgttaactcttgctgtccaggaacagggtgcactgtacattgacttaagtctctgtgtgtgttcttcaaatagtatttacattttttttttttttagagaggcaatacatgcttatggttattcttaggtattttatcttttagtttgtttattattctcattcatttcttaatttaaaggaataatgtgttttagctacacgcacatggaaaaagttatcattggccaggcgcggtggctcatgcctataatcccagcactttgggaggccgaggcaggcggatcatgaggttatgagatcgagaccattctggctaacacggtaaaaccccatctctactaaaaatacaaaaaattagctgggcatggtggcatgtgcctatagtcccagctactcaggaggctgaggcaggagaatggcttgaacctgggaggcagaggttgcagtgagccgagattgtcccactgcactccagcctgggtgacagagtgagactccatctcaaaaaaaaaaaaaaaaaaaagttaccattttgaaactgaactgtatttgattcatttttggtgaatcctggttttcaaaacatgaagtcattggtgagacagactttcatttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgccaccacgcccggctaattttttttgtatttttagtagagacggggtttcactgtgttagccaggatggtctcgatctcctgacctcgtgatccgcccgcctcggcctcccaaagtgctgggattacaagcgtgagccaccgcgcccggccgacagactttcatttttaattgttagtctgttttctgctactgaccgcctttttgtcactttacatatcttctctgagccttagtttcctcatctgtaaattgaagaatctaaaacagatatctaaagcctgtcttcccgctctgcccacattgattctgatgtgattaacttcctagaggccttatatctgctcagggaagccctcttgatgccaggacctatgtgactcccagtggttgaggaccatctgagctctggatttctagtcccttgtggccaggctggtgggccaccatcaaggtcatgtcaggaagctcactgtccaccttctagggctaatttgtttggttgggtagttaaaggtttagggtcctggtttggaattgcttgaagtgccctagtatctcctcgggagttcgcctttccttttcattccctcctctggacccttagctctcagacctactatcctcaggctgtccacatgtctcccagtgcaaccctcattgtcaactccctcctttccctctctgccttctggccctctccccctgtcccctcaatactcagggaaggaagtggagccttgggttgaaagaactggtttagcaacgagtcaggttatgttcttatccacctttgcctttcaatagctatgtgatctttggtaaggtttagagagaataaatgcaaagtactaacccatgattactccagcaggggtcttagtgaattggtttgctcattagtggttaatagtattaatagtagcttattacataaagctatgtgctgggctctgtaataggagcttttacatatgacccattgaatcttcacaaacagccccaggaggagggtaggaattgtgtatcccattttgcagatggggaaaataaagcccaggagaactaacctgtgcaaagtcacacagctaatgagtgtctgagccataattcaaactcagctttaagatgtcactcgtgggactgaggaactgaatttttagcttaccttgttaatttcaatgtagagccacatgtggctagtggctaccatactggacagtgcagttccagatgtgtggcagcagctcagttccacgttagtcaggagggagtgctccttcctcccctctccttctatcctcccatgcccctcccctcagcaggtgggtcttacttttggatggagaacaccttctgagtttaatttttgttgcttctttaattctaacagtgtgaagagtgccagtgctggcagcatggggtctgcatgggattactggaagaaaatgtgcccgagaaatacacctgttatgtttgccaagaccctccaggtagagatttctggagtcagggatataacagtatgtagccttttccttggcacagctggctgtgacacattctaaatgtctgcggtcttgagactcatttcttcagcatcggctagactccagctcctcctcgcctctgttgctatcctgccttgtggccagctatcctgaacgtagcaataagagcacacgtgtgaaggggcccacctagtggaaggcctggccttgagctagaacttttccttttctttaattatggtttaaaaaaaatgcatgaggccgggcgcagtggctcacgcctgtaatcccagcactttgggaggccaaggcgggtgaatcaactgagatcaggagttcgagaccagcctggccaatgtggtgaaactccatctctactaaaaatacaaaaattagctgggcatggtgacaggcgcctgtaaccccagctacttgggaggctgaggcaggagaatcacttgaacccaggtggcggaggttgcagtgagccgagatcatgccagtgcactccagccagggcaacaagagcgaaacttcgtctcaaaaaaaaaaaaaaaaaaaaaaaagcatgagatctaccctcaacaatacagtattgttgttaataactataagcacaatgtcgtacagcagatctccagaactttcatcctgcctgattgaagctgtgtagaaaaatgtagaaacttcacaagtttgagtgtcatccttgtgtaggggccatgctaatcttctctgtattgttcctgttttagtgtatgtgctgccgaagtggcaccttttccttttcttgaggactcatgaggatgggcgtgtgggctctgtctttggcttttgggggctattggagggttagaaacttgcctttgccccctgtggcaacatctgcccttcatcacatcactgccatcctgaagggagaaatgcccttgaggggaaggaggaaggcatggttgggtagagcctgttgccaccctgagcagtgacttaattccttagcaggatcagttagttccatggctataggggtcacctgtggctcttgattgctcctttctagaaggggtggattgtaaatatgcagttcattgtcttggtttccatgggatggtgacattgtctcccattaccacttgtaaggttctccctcagctctagtcccctgattcctttagagctagacagtgcttgagagcctctgcttccgttactcctttctgtccgataaggtgggcctggttctcctactcccagttttgcttatgaggaagaaattgatccttgaggatacagttgactttcctcataaagcaaattggaattagaactggtttgcagagccagatctcttgattttgttggttgtctagggagggactggccaccagttcatttaacagcatgcaggtcccctctgggcctgaaggcctctgttgtgacactgtctccttgtactagaagcatctgcctccacttgtccctttatcccaaggaaagaatagtcagaagatttgacaggtgaacaaacacaagtccagaagggacatgactggcccaagatcacgccaccagctaatgccagacaggcgatgagaaccagttgtctcatacctttgccttgtaaaacaggtagtgcagctctgaatcctgctgctctaggcactgcctgcagcagctgcctctggggttcccccatatattcctgaaggctccttagcataccttttaaaaatctttttttccctactgtgtctttctctctacttttccttctttagaagtcacacacaccatcttcatcaaatcctgtgcacttactgaacttctacgactttaatcgccaatactgtgaatagactcttccttgaactgagcacagcatgtctgccacagggtctacctttatagactgactctgcagagggctggaccaaaagtttaacagattcgttttttaaaggctacttaaaaatagttttaacagaatcaaggtgtatccccaccatgtgtattagtaaagccagaagtagctcaaagaccttaataggaatcacctgggtgtttcaaggtttttatagatattgacagtcgaacaacagtctggtagaaagcttttccctgggactttggagcaggtcatgttgataagtcacatgtgcttttgttttcagtccttcctaaggagccctgtaacaaataggatggctgaagccatccagttcctatgttgttctaatgaatggataacaggtacagagaagggaaggggcctgatcatctgttgagttaggtggtagaaggtacatttgcagggggacttgaggcatctttccattcatttgataagtccattcaagatgccttttgccaggcactggggatacaaccatgaacaagatagttcctactctttcggctcttaattgggttgggagccagaaacagaagttaaaacaagttaagtaaacaagactgtgtaaggtagtgatgaatgccgtgacgggaaaattgataagacgacttgaggcactgatgatgctctcaactttgggaagtagcagaaggccccactcctgggcaacatggcaaaaccccatcaaaaaaaaatgaaagaaagaaagaaaaattagccaggcatggtggtgcacacctgtagtcccagatactcgggaggctgaggtgggaggatcacctgagcccagggaggctgaggctgcagtgagccatgatcatgccactgcactgtagcctgggcaacagagtgagaccctgccaacaaagcaggaaaaaaataaaagcctttctgaggaggtggtaaggagccaaccctgcaaaggcttagggaatagtgctgcagacagaagggatgcgcaagtgaaggtcttgaggctggaaagagtttgatgtgtttcagaaactgaaatgaggccagtgtaaaggtatggaggggaagacaggaaggaactgggtcctgtgggcctcagtaagccagagttagagagttggggctttgggtattctcctttgagcagtaggaggcagtggaaggttttaagtaggggagagaatattatgatataaatttggagataatctaggtgcccagctcacctctggccagttccaggaaatgaggaagtacatgccttattcactaccttatccccactacctaatagagagcccagcatatggtaggtgccaagaaaatgtacactggatgaataaatgaacaaaatgagtatactaatctgttcttccagtagttggtatgataattgtgtgagagtgatgaaatggcctgggtttccttcaggccttgttttaaccctcttgttgtcactgctgtaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcagtaagtgtggcacctgcagtgctgggagcagtctgtttggcatggtctgggggctgagtaaatctgagaaattggaaagctaccaaagcaatcaaatcataaaactgagtttgagacctttactaaaaattatcagtttcaggataaacattctttaaaaaaaaaaaaactttattgagtaatatcttacatataattaggttcatccactttaagagttcattgaggccgggcatggtggctcatgcctgtaatcccagcactttgggaggccgaggtaggcggatcatgaggtaaggagttcgagaccagcctgaccaacatggtgaaaccctgtctctactgaaattacaaaaattagctaggcgtgctggtgtgcgcctgtaatctcagctacttgggaggctgaggcgggagcatcgcttgaacccgggaggcggaggttgtggtgagctgagatcgtgccattgcactccagcctgggcaataagagcgaaactccgtctcaaaaaaaaaaagagttcattgaattttgacattgtatgcagccgtgaagccaccaccagaatcaatacatggtgtgtgtattttggtttgttttttgttttggcatacagttctgagtgtttttttttttttttgagatggagtctcactctgtcacccaggctggagtgcagtggtgagatcatggctcactgcagcctccacctcctgggttcaagcgattctcccacttcagcctcccaagtagttgggactacaggcgcatgccaccatgcctggctaattttttgtgttttctgtagatatagggttttaccatgttggccaggctggtcttgaactcctgacctcaagtgatccacccacctcgggctcccaaagtgctgggattacaggcacgagccactgtacctggctgagttatttgtttttaattgctgtaagatatacataatataaaatttaccatcttaaccattttttttttttttttttttgagacagagtctcgctctgtcgcccaggctggagtgcagtggtgtgatctcggctcactgcaacttctgcctcccagattcaagtgattctcctgcctcagcctcctgagtagctgggaatacaggcgcacgccaccacacccggctaatttttgtatttttagtagagacagggtttcaccatgttggccaggctggccttaaactcctgacctcaggtgatccacccacctcggcctccgaaatttctgggattacaggtgtgagccactgcacccggccccatcttaaccatttttaagtgtacagctctgcacagttgtcattcatgttgttttacaaccagtctctaaaacccttgtgaaactgaagttctataccctttaccaacagctctccatttccctttccccaaagcccctgacaaccagtattctactttctgcctctctgaatttgacttctctagagacctcatgtaagtggagtcatatagtgtttgtctttttgtgactggcttatttcacttagcatagtgtcctcaaagttcatccgtgttatagcatatgtaagaatttcctccctttttaaggctgagtaataacttgttttatgtgtatgccacattttgtttatccctttcatgctaaatattccttttttttttttttaacaagagatggagtcttgctttatttcccaggctgaagtgcagtggctactcacaggtgcgatcatcaagcactgcagcctcaagctcctgggctcaagcaactcagctcattcttttttttttttttctgagacagagcctcgctctgtcacccaggctggagtgcagtggcgtgatcttggctcactgctacctccacctcctgggttcaagcgattctcctgccttaaactcctgagttgctaggattacaggcacatgccaccacacctggataatttttttttttttttgagaccgagtctcgctctgtcacccaggctggagtccagtggcatgatcttggcttactgcaagctctgcctcctgggttcacgccattctcctgcctcagcctcccgagtagctgggactacaggcgcctgccaccacgcccggctaatttttttgtatttttagtagatacagtgtttcaccgtgttagccaggatggtctcgatctactgaccttgcgatccacctgcctcagcctcccaaagtgctgagattacaggcatgagccactgcgcctggcctaatttttgtatttttagtagagatggggtttcaccatgttggccaggctggtctcgagctcctggcctcaactgatctgcccatctcggcctcccaaagtgctgtgataacaggcgtgggccactgtgcccggtcggtctcttggctgttataacctaccctactttaccaaatacagcaacagggccttgagtggggtaggcctcttccatggtttccatgggtggagcctggactagaatccaaatcctggctctgtcaggtacttttcgaactgtctctctatgtgatactgcatgaccttgtgagctttcttttggttttagtatagtctgtgtcagggactgcttttatttaagttgtaaacagtggcagactagtgcgatgagtgagttaagacttgataggctgctcctggataggatttcctttgtgctgatcaggcctagaggaggcctggtgtcaggcagagtggagtatcaggaccctgagatggtgagatgggaatctgcttcctcttgtgctctctggcacacagaggcctggcttcaagatctgcgtgacaaaggtggtggaggagggaacattgggtctgcgttggtttgggtaaaagctgaggtgctataacaaggaccccccacatagaggctcaaacaaaacagaagtttctttctcatataaatgaatggttcaaggctaggcagggatctaggctaggtaggagacctttctccaggattccatccgttgggttgggaactttgtttccttctgtcttacggctccagcattctcttagggttccccttatctgcatggtcttaggttccttttgtcttattgctctggcattctcttgggataccccccatttgcatggttgaagcagtttcacctgcatttcagctctaccccagtccccaggagggggaaaagagagaaagaagagggagggcaaatagtttcatggacaggcctaatggcagggcaggctgggcaggtggccacaggccctgcttatacttagaagtaggggtgggggtggggataaaaggaggagaggttggatgctggggcaattagcagttgctgtggcagaatctgttgaggtgaactgaaccaaatgacggccctggataggatgtcagagactagctatttcctcacatttcataaaacaggaaaacgtaaccccatgtaaaccaaatgaatttgtttttaatgagatggcagcaattaaatgaagtaggtggatggtggtccacgtgagtgcctgggaaacctcaggggctgctcctgattgtaaacttagctatatttctttaaaaaaaaattttttttttttaagagatggagtctttctgtgttgcccaggctggtcaagtgatctacctgccttgccctcccaaagtgctggggttataggtgtaagccactgtgtctggctcatatttcttttatttttattattttcttctcgacagtcttaatagggctgaactttttaaaaataataattgttatcctcccacctcagcctcctgagtagctgggactataggcgcctgcatttcttttcatttgagggttctgtcagatgctgttctcttttttcttacagaaatgccagtgttcctggccctggcccatattctgaagccttgccctttctttttttatgtttttgagacaagggtctcactctgtcacccaggctggagtgcagtggtatgatcgcggctcactacaacttctgcctcccgagttcaagcgattcttatgcctcagcctccccagtagctgggattgcaggcatgtaccaccgcacctggctagttttcatatttttagtagagactgggttttgccatgttgcccagggtggtctcgaactcctgggctcaagtgctttgtctgcctcggcctcctaaagtgctgggattacaggcatgagccactgtgcctagccccttgtcccttctgaatcctcatctagatcctccatctttagagaaattactttgtttgtagtagaattaaatctgtcttctagcaattcagaagagggcataggaagatcttggtacttcttacaaatggagaaaagatcctgggaaaggggaaggtggccccagtatgtctctgtattcatggatggtctctgttgtcatgggctctgggtctttattctcagaaatattgttccccagtgacctggtgaatttattttcgaagacaaacaataaaactgggagtaacttcagagcatctgtcatcataaaaaacatggcctggatggctgtgcttaccttcttcatgactgacagggcttacaaggaaatggcagggtcatgcttgcgagaagtagcaccttcagatcgcagttggaaggatgaaaattgtaggtgggaggaagcagagactttaatggtttttttaataaagagcaggtctgtactatggttcgtgtgttccatgttaacaggtagtggacctgaaagttaacaatgactcccatttcccctgagcagttttagtggtgtgtctgggtcctgggtaggctcctgggacaggctgataccctgtctggaggtatcccaaacaattgatgccaattgtttcccctcttccttagtggctagcagtggtatgggattgctggagtgggagagctgagacgggatagttgcaggcccttgggagcagaattttagttctgtaacatcgctctatgccttcatgtatatgaccacttccactttcacaggaaggtacaggaaggcatccacagcattttatgtgcacatacatggaggcacagctttcagtagatgctcacaggagtctggccctaaaaaggataagaatccctgttcttttctttaataacaaacttttttctttggaatggtgcgaataaattttcagaataatttttagaagctttatcattaatgacctatacataaaggacagttgattttatttttttaacccctgggtaatcattgcatttttgtaatcaaatgccattacatgctgggatcattgtgactgtttattaataagttaaggttatttttagtaagtcacatttgaagagcactttaccaccattaattcacttaattgttatgaaactcagtgtttgatggtgttggcaaaaagagtcaaattctgtaaaatacttgaagatatttattctgagccaaatatgaggaccttgacttgtgagacaccctcaggaagtcctgagaacatgagcccaaggtggtcaggctacatacagcttggtctcacacattttagggagacataagacatcaatacatataagaagtacattggctgggtccagaaaggcagaccaacttgaggggtgggtgggcttccaggtcataggtagattcaaagattttctgattggcaattggttgaaagagttaagttattatctaaagagtcaagttattatctaaaggccagtcgccaggcttggtggctcacgcctttgggctcccagcactttgggaggtcgaggtgggcggatcacctgaggttgggagttcgagaccagcctgaccaacatgtagaaactccatctctactaaaaatacaaaattagctgggcatggtgacgcatgcctgtaatcccagccacttgggaggctgaggagggagaatcgcttgaacctgggaggtggaggttgtggtgagccgagatcgcaccattgcactccagcctgggcaacaagagcgaaactccgtctcaaaaaaaaaaaaaagaaagaaagaaaggagtgtctgggttaaaataaggggttgtggagaccaaggttcttaccatgtagatgaagcctccaggtagcaggcttcagagagaatagattgtaaatgtttcttatcagacctaaaaaggtgccagactcttccttaattttctcctggatcaggaaaggacctggaaaggaaaggaggttctctatagaatgtagatttccccacaagagacagcttccagggctagttcaaaatatgtcaaagaaatatattttggggtaaaatactttgatttctttcagtacctgctatctgttatgttggtatcttaattgctacagtctgttttgtcagtctgagggtctctattttaatgttttgttgttgttgttgttttgttttgttttgttttttgagacggagtcttgctgtcgcccaggctggagtgcagtggcgcaatcttggctcactgcaagctctgcctcctgggttcacggcattctcctgcctcagcctcccaagtagctgggacaacaggcacccgccaccacgtccagctaattttttttgtattttagtagaggcggggtttcaccgtgttagccaggatggtctcgatctcctgacctcgtgatcctcctgcctcggcctcccaaagtgctgggattacaggtgtgagccaccgcccccggcccgttttaatgttaatgctggtcagttgtgcatgaattccaaagggagaagggtataatgtggcttgtctgactcccttcccatcatggcctgaactagtgtttcagtttaatgttggaatgctcttggccaagaggaggggtccattcaggttggttgaggggcttagaattttatttttggtttacaatagcagacagatcagacagataattagcccagtttcacagaggaggaagtaggaatgatgctggttgagtgagttgtcccagagttgaaatccagtcaggtcttctgactgagagtccagtcccactcactgtgtgtgaccacagtgggagctcactaaggagtggtctcctaggagaccacggattcacattcgctcttgtttagcaaatggtagtgtgtggtcagatggcccaggtggagctgctgtccctactgggagagtatttaggaattgagaacccctgcaatggtgccagttactccaaagcccatgtcctctttgtcctctcaacagaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtatgtggctgccttgtacttgttcttcattcattgcgtgaatgcttgcaagttatcctcctagtttgaatgctctatggaagatatttattaataaaactgtatttaaatttgcttaccatagatatgttttggtttgccaaaatgggtgcaaagtcaggagagcccacttaagccaaagatccttggttccaggaagcacccacaaaatggcatagtcaagtgtggcacgtggggtggggggcgcgggtgcagagggagggagaggtgggaagtagcaaggagatatggattagcaaaactcatcttttctttaaggcagtttgcattataattgcacctagatgttaattcttagcatgagcaaacaatgagtcaaatgttttgttaggcagaattttttcaatccagttgtatgatagctttattttgacttttaactttgaagccctgtggtaaaaatggtacactttgtcaaaatattgctggtttcatcagttttcccaagagccacttttggttttttgttattcaagtcattctcttctagaacccccttgtatcacctcgttgccggtgttttcatctctaactgctcactaggctcattgtgccctgtcctcagttgtcagtgaggctttgtatgatttgagagtttctctgtctcatcatccttacttcccagactttctcctgcaggttggtgtcaccagtgttaaatacattgctgcatggtgccaaggggatcctagattacaagcccctcaagggaggggattgtatctcatgcatccttgtgcccttgactatgtctaaacggtgttgggcaaggtggtaagaacacagtcttttgagacagacgcagtttcaattctgagctcagccccttactgtgtgattctgagcgggttacttcactttcctgatcagacctgttttctcgcctgtagaatggggccagtgaagccccctcagttactgtggaacatatttgtgaaaatccctcagtaaaatccctcagttttgcacatagtaagtactaaataaatattggctagaatctatttcatttcaaatggatgaatgaaaggttgagttaccaaatcctagaaaaggtttgtggtcctgtggatcaggcaggtttcctagaggtatctggcacataaaacaaagccaggaaatactgggcctcagcaaagcaaccagggctaacagtcttttccattgatggtaagctgactgtaagctggccttgcttttatgtgccttaccctatttcatcctcatgaaccttccaaataggttttagtacccccatcctcccaccgagaaagcagaggctcagagacatgaagtagtccatccagactcgcacattcgcaggagatggagctgagacttgaaacgcgttggtgtgactcccgtgtactaacccttgtctgcactagccctgctctaatcacctctcagggctctggaagccattctgtgaggcttactttaggctaggacattggcccagtcagtaggaagcagctgtgggtcccctgagctagagtgctaccctgaggtagttggaattggtacagtgggcaagctcctgcccagttcctaagtgggaaataggaaagggaggtagggatttggagtattgaaactgcagctagtatttcaggtggctggaaatgctggctggttgaaaaatgggccaggggctatctccattcagtaatttccatgccattgcatccccaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatggtagggctccttcattggccccctgtgcattggcatgcagtcgagcacccccagacgagctgctttctgaaccccccagtctgagtttacagggaccgctgtactctttgcttctcttcttttcagcctctccccacctccattctcccctcaggatggatgagccttacttttagtatttatcaggtgcaagatctgcatgatgttgggtcctgcctcacttgtctgatcccttctgtaaagttgagtatgcagagagagggcaactggcagtcctgcttgcaggaaatatgtgatctaagccaatctttacaaacaagttctgtgagaaattaaaattttgacttgagttttaggatatctgaggatttaatctgaaaaacctcttattccaatctttgataaaatctaaaatgaagctttctcctcgtaagccagtagagatttgagaatttgcctgagtcatttgtatagccctgagtattccttccagatattggtggttacggacaggcctggaggatcaaaccggtgatgatgaacatgatcaagttcagtctctctccaggaagttgacggttttggttgttgaaatattccctaattatttgttttcatgttgaaaatggagcccagttaaaaaagaaatgttgtttgaggattctgggtacagtctggctatgattttttactgtaactgggaatataaaacatacatgaaataactcaggagaaaatgccatctgttatacaagtgatgccatgaggtgtggccgggacacatgtggctgatgtcaatgcagaggaggagagtgctaataggagggcttcctaaaactcctgagactgaagttgagctttaaggagagtgatggtgtttcctactggagaggactcagggtggatgatctggctagactggaaaaagagttgccctgttggaggacagtgagagagacagcaagacctaggctgggtgtggtggctcacacctataatcccagtactttgggaggtcaaggtgggaggattgcttgaggccagcctgggcatcacagtctctacaaaaaaataaaaaactagccaagtgtaggggtgtagtcccagctacttgggaggctgaggcgggaggactgcttgagcccaggagttggaggctgcagtgagctgtgattatgtcacggtactccagcctgtgtaacacagaccctgtctctaaaaaaataaactaaaaaaaagggattgtaactgatgccactgtctgtgaaaaacatattattagagagctgaaggaggatataatgttagacaaaaaagtgtagctcttgagagaatggcagtaggagtggctctgtagtccctgaaaagaggattagcaccatggaaacagggtgaatgttcggttgttgccacagggaccttccctgagggagaagttaaagtctactcacatcttacttccttaatcctctcttcagccaggtttggcctctctagccctgccgaatgggcagtgtggcaaggatggtaggcctgaacccccttctttggcctcacagatgacctcttgtgtgtcttgctaattcagagccacatattctgtacatttctaagactctaggccctgagagagataacaagaaagcattaaaataaatgataaagcttaaagattttatttaggtaaacagacttttgcatagtatttaagattaatcaaaatccctttttatggaatcaactctttatttaaacaccaagataaactaagctttctttctttcttttttttttgagatggagtctcgctctgttgcccgggctggagtgcagtggtgccatctcagctcactgcaagctccgcctcccgggttcacgccattctcctgcctcagcctcccgcgtagctgggactacaggtgcccgccaccaggcccggctaattttttatatttttagtagagacagggtttcactgtgttagccaggatggtctcgatctcctgacctcatgatccgcccaccttggcctcccaaagtgctgggattatagacgtgagccaccgtacccagccctaaactaagctttcataaccaagttttaaaataggaatttggatgtaacattccttttttaaaaagccggcctgcttagctgggtgtggtggtgcacacgtataatcctagctacttgggaggctgaagcagcagaatctaggaggcggaggttgcagtgagctgagatcatatcactgcactccagactgggcaacagagtgagactcagtctgaaaataaaaaatttaaaaaaatttaaaagctgacctggcgtggtggctcacacttgtaatcccagtgctttgggaggccaaggagttcaaggttacagtgagctatgatcgtgtcactgtactccagcctgggtgacagagcaagaccccatttctttaaaaaaaaaaaaaaaaaagcctagtaagctattatatgaaatatatatatatatatgccattgttttacaattggccattatttaattatttatgtagttatatgaatagtactttatttatttatttatttatttatttttgagacggagtctcggtctgttgcccaggctggagtgcagtggcacgatctcggctcaccacaacctccacctcctggcttcaagcaattctcctgcttcagcctcccgagtagctgggattataggtgcacaccgccatgcctggctaatttttgtatttttaatagagacggggtttcactatgttggccaggctggtctcgatctcctgacctcatgatctgcctgcctcgggctcccaaagtgctgggattacaggtgtgagccactgcacccagcctgaacagtactttaaaactaaaagacaaaggatatttaatgaccatgaaaagtaaaaaagtcttttggcattagagagattattttcttaaataaaaaatgttgccttggtgagcagtggtctctatacacatgatcttagtgtatttgaacagaattttttcctctgtaaccttctgtcttgctagcaaccactatgctagttggaagctgttctgcatctttaaaagagacacttgggatggtgcagcacatggtatggagagggtggcctgctggatgctggggtccagaggagatgctgttgacttcccacagtcctggctttgttcttcagcctaacagacctagacagacagcttccatctcaggaactccacacactcctgttaaccaagctcaggcactactgagtggcttagactcttccagtctgagcgttggtgcgctttcacactgtgcatgcctcctgggccaccgtagtatcgggatgtctttggtgagcctggaactagatccaaggtagttagggtgaccttaagaggggcctctcagcaactgtaggatcatcttgcaaaagattgactgactctctttgctgttggagtgacccatccagtcctgactgccttttgtccatttatttatttttattttattttatttttttaagacggagtcttgctctttctcgcccaggctggagtacagtggcatgatctcggcttactgaagcctctgcctcccaggtttaagcgactcttccttcctcagcctcccaagtagcaggcagatgcctgccaccacacctggctgattttgtatttttaatagagatggggtttcaccatgttggccaggcttgtcttgaatttctgacctcaggtgatccacctcccttgacctcccaaggtgttgggattacaggcgtgcacgtccggcctctccatttattcttctgcctgtttgctgaacagtcccctgtctccttctagttttttttaaagacttactggtgttttgaaactggtcactatccagttttcttgctcagcaggccactagttcctctcacatgactgatcttttactaatggttttcaagcttaagtctgaggaggtggtcttatttttcttatttccaagtccttgtacttgctggaattaggaagagagagggttcctccttcttggaacccccaaataccaacaagaaatatgatggaggaggataaactacatagggcccagagcaatgggtagggcgctttgctggaccacacattccttctctcgctgtgtttgttgcaggcttgccacatttcagacacaggtgagtgttagggatatagtggcaagcaaggcagactcagcctttgccctcgtggaacttgatctagtgggagagacatatattaaacaaatcatcccattacctgtaatgacaaaccatagtaaatgctcaaaggagaacatgtgatatcatagcacctgtaacacaaggaccagattcagggtatagggttggggaaggcttccctaaagaatagctcacaagaaacagaggatttagaaaggtggagaggaaggtagggctgcatctgaggacaggagaggattgcgcagtaggttgcaggctgcttgatgaagaggtactgggtgggcctttcttttgctgcactccagggtccagaaggtgctcagtacaggttggtgcatggactagaaaggctacaggcaggctgggatagcacaggggctacctgcagggggtggttcttgtcaaaggtgcagggttcccagatggtctctccccaaatgccagagctttagggggtagcttagggaagaacaaacatctttctgtagagaaatacttgttctcacaagcaagacagctttctagatattgaaccaatgatgataatgttaattaatacctgaaatcttacattaaatatttaaaggggtcctgcatggtggttcatgcctgtaatcctagcactttcaaagtggccaaggcaggtggatcacctgaggtcaggagttcgaggccagcctggccaacatgatgaaaccccatctctactaaaaataacaaaaattagccaggcgtggtggtgtgtgcctgtaataccatctcctcaggaggctgaggcaggagaatcgcctgtacccgggaggcggaggttgcagtgagtcgagatcattgccattgtactccagcccaggcaacaagagcgaaactctgtctcaaaagaaaaaaaaaggccaggcccagtggctcatgcctgtaatcctagcagtttgggaggccgaggtgggtggatcacctgaggtcaggagtttgagaccaaaatacaaaaattcgccgggcgtggtggcacatgcctgtaatcccagctactttggaggctgaggcaggagaatcgcttgaacctaggaggcagagattacagtgagctgagatggcgccactgcactccagcctgggcgacacagtgagactccatctcaaaaaaataaataaataagtaaataaataaagggagaaaataataacagagtattctgtgccactgatgattgcgtatcaatcaggaattaatatgaagcaaatcagagtttatgatatacaaatagaccttttcaagaccctatagattttcatttttcttgacaggatgctaaaacaccaggctctctgattttcaacatgggaaagctttttattttttattttattttattttattttattttatttattttattttattttattttattattttatttattttattttttgagatggagtctcgctttgtcgccaggctggagtgcagtggcacgatctcggctcactgcgacctccgcctcccgggttcaagcaattctcctgcctcagcttcctgagtagctgggactacagacgggcaccaccatgcctggctaatttttgtatttttagtggagatggggtttcaccatgttggccaggatggtcttgatctcttgaccttgtgatctgcccgcctcgacctcccaaagtgctgggattataggcatgtgccaccgcgcccggctgggaaagctttttaaagagtgagtggtaacactcagaaaggtgcttccttccaagacttctagactctggtaacagtagcctctggcaatgtgtggctgtttaaccaaaactgaataaaatttaaaattcagttcctcagttgcattagccatgtttccagcgctcaatagctgcataaggctagtggctactgtattggatgacacagacttggaccattgatcatcgcagaaagttcttttggactgtgctgctctaaagcatttgtgttttgtcctgggagtaccactttgtagagcaggtgttgacacagtgctggctgaaatggcccttcctcccttgccccatggaggctgaaatggcccttcctcccttgccccatgtctgatggaataaggtgctgaaatgcttgctgatgttcttgcaaatcaagtgttgggagttcactaggtctcatctctctcttctgccgacagtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgtattgttgagttacagtcatgcatcatataacgtttctgtcaaccatggaccccatatacagggtggtcccataagattataatggagctgaaaaattcccatcacctagtgatgtcctgatggtcctactgcataggcctaggctaatgcgtggatttgtcttagtgtttaacaaaaatctaaaaagtaaaatatatataaaaaatttaaactagaaaaaaactcatagaataaggatataaagaaaatatatttgtatagttgtaccatgtgtgtaaacacaaagtgttattacagaagtcaaagttaaaatttaaaagcttacaaagtataaaagttggtcaggcaaggtgcctcagatctgtaatcctagcacttagggaggctgaggatggagaccctgtctctaaataaaaggctgggtgccgtcgctcacgcttgtaaccccagcactttgggaggccaaggcggccagatcacctggggtcaggagttcaagaccagcctggcaaacatggcaaaaccccatctctactaagaatacaaaaattagcatggtggcgcatgcctgtagtcccagctacttgggaggctgaggcaggagaattgcttgaacccaggaggaggaggttgcagtgagtcgagatcgtaccactgcactctagcctgggcaacagagtgaaactgtctcaacaaaacaaaaaacaaaaacaaaaagttatggtgaactaaggctaatttattattgtagaaagaaaattaaaaaaaataagtttagtagttcgtgaccagcctgggcaacatggtgaaaccccatctctacaaaaattagccaggcatggtggcatgcacctgtattcctagctacttgggaggctgaggcaggaggatcacctaggcctgggagccagaagttgcagtgaacctagattgtgccactgtactccagcctgggcaacaaagtgagatcctctctcaaacaaaaaaaaattagtctatgtgttcagtgtttatataaattctggagtagcgtacagtaacgtcctacatcttcacattcactcaccacttacccagccagaacaatgtccagtcccgcaaactcttattttttacttttatatatatatatatatatgtgtgtgtgtgtgtatatgtatatatgcatatatatatgtgtatgtgtatatatgcatgtgtgtatatatacatatataaatatatataaatgtttttttttttttttgagatggagcctcaccgtgttgcctaggctggtgtgcaatggcgcgatctcagctcactgcaaccttcgcctcccaggttcaaacaattctcctccctcagcctcctgagtagctaggattacagttgcccgcaaccaagcccagataatttttgtattttgagtagagatggggtttcaccatgatggtcaggctagtctcaaactcctgacttcgtgatccgctcacctcggcctcccaaagtgctgggattacaggtgtgagccaccgcacccggcctattctatatttttacttaaccatttctatgtatagatacacaaatacttaccattgttactgcctatagtattcagtacagtaacatgctgtacaggcttgtagcctacgagcagtaggctctatcacaaagcctaggtgtgtgtaggctataccatctagtttgcataagtgcactctatgaggctcacacaataaaactgcctaagggctcattttcagaacgcatccccattaagagatgcatgactgtataaagttcttcaccattcttttttttttgagacggagtttcgctcttgttgcccaggctggagtgcaatggcgcgatcactgctcgctgcaacctccgcctcctggtttcaagcgattctcctgcctcagcctcccgaatagctgggattacaggcgtgcgccaccaagcccggctaattttgtatttttagtagaaagacagtttcaccatgttggtcaggctggtctcaaactcctgaccttaagtgatccgcccgccttggcttcccaaagtactgagattacagccatgtgccactacacccagataattttctatttttagtagagatgggggtttcactatgttggtcaagctggtctcgaactcctgatctcaagtgatccaccgcctctgcctcccacagtgctgggattacaggcgtgagccactgtgcttgtccttcttcacctattctaatcttctttaaacattaccttttaaagaaggctgttcttaccttctaaacaactatctttttccagggaggcaggtgcaaactctgccaagaaatcccaagaatgcaaaaatacttctcaatttgtctgtctttaatattcaaaagcaaattgcccctcaccaacttccagcccagtctcactcatgctttgtggtgtgaactgcaggctgattttgattgttgagagcagtgcaaggaagacaagtctggccttccttatattaacaaatggcactcactgcaataggacctatctgggaccaatccaagctgtccatggaccctaactagctccttcctggttgggcagaagcctctggaaacagagtaggtttaagatttcagaacaggtcctcattatttgccaaattctttcttccctttgtaaacgattatgctagtttaaacaccaaaagggagccagccggagagacattaaaatgagtagcttcagtaatgtaaataatccattacttcaactagttctgctttattcctaccacaggcctaaaatttggcaaggaagttgagcaagcctggcggcataagccagagctcacaagaactagcctatctctgtgaaggtgtgcagtaaacacttcacattaaaatggcccagtaacttggacattttgggaagcctgtacccaaagggcaggtgcaagttggtgcccatattggtatagaggtagccagttaagtgagcatttaatagagccagctattttgcgtgtaagaaacccaagtgggtccttgggagcccaggtgaaaaacttcccatgtgtggtagagggataacctaggttcagtcaacatctaaagatcccactatagccaacgaaggccttattgttacggactcccaacttcgtttcgccaccagccagaaaggcggtaggaaacaggcttggtaaaataaacccaataagaacgaatgaaagagacacaccagaccacaggcgctgccaaaactcatttttcattaacacggggtggggtcccaggctcaggcccccgggcccgatcatggccccagtccgcacagagcgcccggccctggccgcccgcagctccaccgctcagccagtgatgcgcacatccgtgcggcggcggatccgccgggcccgagccgcctcgggcaggatggcgagcagctgctcttgcaccagcatctccacgatctgctccttggtgcggatgtcaggccgcagccactggcgggacagctcccgcagctgccggaaagcctcccggggacccgccgcatcctggtagcggaactgccggaaacgctggcggaacgtctcgggaccgagtctagagccggcggggcctggtgtggagcgcgcttcagcttcggcctgaggcgctacgctcacgggtgcgggcccgagaggcagctccagggccgcggaggccgcagctcggggcgtagggatggcttcagggaccgcggcgttgggactggaaggctcaggggcaggcggtgaggcctctggcagcgaggagcccacacagttacgctcaggggctgagctcgaaccggctccttccagtttctccggtggcaccgccgcgggactcccagtggccgccaagatcggctccgtagccgccataactccagctccgggcgtcactctttgtccggtagctgtgtgctcagcactgcgtctgcgcgggggtggggtgagcagggagacgtttccggttaaagggcagagctcgcgtcacccttgagggagtcggactcgggaccggccgagagtgtgcggagcttacctgcaccagcgaagcgcctgcggcagccggaagcgaaagtctctggcttctctgcgtccaggtcggcgcgcgagcacccggaagccgcttgcgggctcccggaagcggcgccctctagcgttctcgagtcgcatgaggcggctgctgccctcgcggtgcgggagggcgagctgcgcgtggcctgggctccttccgaatggtggcgcctctgagcgccagttcgaggaggagtcggaggaggagcctgaatgtttggagatagacttcaagtcccggaccttatccgtgcgccgcttcggtttgcaggtgacctttgcgtgcgggcgccccttctgattgaccctgatgagctgtagctctgatggcccctccttcgggaatgattagggtgacggctggccggggctcgttcgagtggcgcccggccggtggtgacccgaacaggagagcgggacggcgaccattctctcgggaggggcccatctggagaaagtcctctcgcttggtcaaactaggagggcgatagcaccggccttactgcgacgatgacaaagtacaacacaccgtctggcgcgaaggagatgctcgagaaccctttgctgttgttatttttcgcgtgtcctccgaaaccaagggaaatgcggctctgtgggttctgttaacgtcagcatttaataagtgaactctaaatgcattgccccttatggtggccgctggcctcctgagttgactcagctcttgcaacgtagctagttgataaccctcgaaatatagcgaattgagatgtgctatattgtaaaatacgggacttagtacgaaaaaactgatgtaaaaattatctcaatactttttaatactgattacatgttggaatataatgttttgcatatattgggtcaaataaaaatgttattaatttcacctgtgtttttactttttaaatgcagcttctaaaaacatttaaattgcatgtgcagtttacattatatttctgttgagcagccttgggttagagtgttggagtgaggctaccttggtggaatcccctttgacgatacccagctcagagttgttaggaggattaaataaattaagccgttggagagaaagggcttttaagaagtttgctcttgtttttattaggtaaactgcttgctatctctgagctactgttttcttatcagtaaaatgtggatgtaatagaacttacctctcagaggtaattgagaattcagtgagatgatgtaggtaaaagcacgtggccctgacagccctcggccaggtggttttctgtttggtagctgactcacaaatagttttgtttttgtttttgtttttgttttgagactgagtcctccgcctaccgggttcaagcgattctcctccctccgcctcccgagtagctgggattacaggcgcccaccaccacacccggctaatattttatatttttggtacagatggagtttcaccgtgttggccagactggtctcgaactcttgacctcaggtgatccactctcctcagcctcccaaagtgctggcattacaggcgtgagccaccgtgccgggccacaaataggttttatatcctcattttacagaaggggaaactgaggccctcaaaggacaggggcctcatatgaaaggttttctatgaccttgcagtccttttgagcccgtgcaggatggaggagcaggtttaacaaccattaacatgccattagccctgatataaaacttacccctaccataggatgtttcctttggatgggtagaagtggaccctcatgaaatcatttccatagcctgaaaaccttgaaagtcgttgcagtgggcctttaatgttttttagttgctgacatgtaaaaattgggagatttcacatgcaaatctggatttctaatttttcttgaaaaaacggaagagctggccacactggacccaaattcctgctggtcaacaatcagctgacactgagtagagacgacttcctttagacaagatactctgtcccatttggtctcaatctcaaccattccctatggttctctgaaatagaatgttgtttgcatttactgttgctctcaggttgttgctttatttagagttgatatttttctctcttttctttttagaggtgagaaagcagggtcttagtgtttgttatgcctactggcttcaaaccttgacttctgtctggcccctcagtagttgggtttgctgcccagagtgaccaacagtgctattccctgtgtggtaacaggtactcagtttctaggcctaagggagcacactaacccttctgtggaggcaagaggtgatagaagtcttcactggggaggagacttcaagctgagactcaagaacaaaatgggtggggctcagggacattccaggtagaaggtactgcctgtacaaaggcacatagtgagtaggagcaaaactgtggaaactgcaggctatatgggaaagtggttgggatctggagaaggggtgagagatgaggttggaacactggtgggggttaaatcataaatgtcctagaattccatgtttaaaatttagttattatcttcttgtgaaagggaatgaacttttgtggcacctggaatcatgagatgttatgttagatctctagtctatttcttccatccctattgaaatcgtgaattattagagataggaggagggacctgagagatctattagaatcattgaatgtcagactggaagggcccttagaaatggaatttaaaaatccagccctttgtgggccggtaagcctgctttaaagtgattcagcagtaaaaaaataatgtggagggaataaatgaaacaagattggctcagtagttggccgggcgcggtggctcatgcctgtaatcccagcactttgggaggcataggcaggcggatcacctgagctcaggagttcaagaccagcctgggcaacatgatgaaaccctgtctctactaaaaatacaaaaaattagctgggctcggtggctcatgcctgtaatctcagcactttagaaggcttgaaagattggcagtatgtacactctactttggtatatgcttgaaaatgtccatgataaaagttaaaacattcagattcccagaatctgaaaaaaaacatataatgcctcttcttcgaaaagggatgcagttatctactttcatgtaatttacatatatccttgaaccctcccagaagtcccagattaagcttaaaatatacatttatatttcattcttttgaattttgcagattgagaaaccaagatgtcagaagatgaaggattggtccaaaataagaaagctagtaagtggtttcatgaggacagaaatcttttgacttttagtccaaactcttatcttattaggcctctttatccctagattgggagttcacttgggaagggatcataactcattcatctcatatcacttagcttccaacacaaggcctgactcctaggtagcttcagtgttgattaaaggaaagaggacaaatgtggattgcagaccatccctgagaaggcagagctctcatatgagtcccagactctttcagagacctcagtgccttttgatggcacttggttgttgagggttgtggaaaagaagcttggatacttattttcttttttatcagagccatcacactggagaatacgtcttttaaaaagcttttcattggccaagcatggtggctcatgcctgtaatcccagcactttgggaggccgaggcaggcggatcacgagttcaggagtttgagaccagcctggccaatatagtgaaatcccatatctactaaaaatacaaaaaattagctgggcatggtggcaggtacctgtaatccgagctacttgggaggctgaggcagaagaatcacttgaacccgggaggcagaggttgcagtgagctgagatcgtgccactgcactccagcctgggtgacagtgtgagacttcatctcaaaaaaataaataagttttttatttggaaataattatagattcatagaaggttgcaaaaatagttcagagaggtttcatgtacccttcagtcagttttccctaatggtaacatcttgcataactatagtacaatatcaaaaccaggaaattgacattggtacaatccacagactttattcacattttcccagttttacatacatgcatttgtgtgtgtgtgtgtgtgtgtaggtctatgcaattttatcgtgtgtggattaatgcaactactaccacaatatctagaactgtctgatcaccacagagatccctcgtgctatctctttataattgcatccattcatcttcccttcccctatccctaaccacaggcaaccactaatctattctccatgtctataactgtgttatttaaaaaatgttacatacctggaatcatatagtgtataatcatttgggcttggctctttccacttggcacaattccctggagattcacccaagtggttgcttgtatcaatagtttgtcctttttattgctgagtagtaatctatggtatagatgtaccatggtatatttaaccatccattgaaggacatttgggttgtctccacctttgagctgttacaaatagaactgctatgagttattttatgacatggctttgggtaatcacttatctttctgagcctggaaatagtaactaccacacaggatggttctgaatagtcgaggaggagaaatatatataagggaactggtgcagggtttggcacagaatatatacttcgtcatttttttaaaaccgatggttatgaagagataatacttccttgaatatgtaagttctagtatgtagtatttttaaaagtcacaggcattgatattattattagtgtattagtctgttctcatgctgctaataaagacatacccaagactgggtaatttataaaggaaagacgtttaatgaactcacagctccacgtggctagggaggcctcacaatcgtggtggaagacaaggaggagcaagtcacatcttacatggatggcagcaggcagacagaatgagaaagtgaaaggggtttccccttataaaaccatcagatctcgtgagacttattcactaccatgagaacagtatgggggaactacccccatgattgaattatcttccactgagtccttcccacaacacgtgggaattatgagagctacaattcaagatgagatttgggtgcggatacagccaaaccatatcattattgaacatctgtgtatgtgtgatactttatttacagatgagaaattaaggtctagagagattaattaacttgcccaggttcagccaatccatggcaagattgggattcaaacccacgtttaacatagacagtaggaaccatggaaggacttaaagcaggggaaggatgtgatcagatttgtgttttaggagactcagtctggatgcactgtaaagaatattgctttattgctgaacacttagattatttctgatttttcattaaaataatgtgataatcatatattgcttaaagcttgttctgattttgaattataagcatctattactatcaaatctatttggtctctgagtttgaaaaggaagcattctgatagcaagagcttggatggtaagggataccagtacttccttaagctgtaatcccaaaagaggactgactgaaatattttgctacatattgccacctttctttctatagacatgtgtttgattcatagaaccttaggacaacccctttacttcacagatgggcaaactaaagttcagaaagtagaagtactagccagggtagaatccagggcccagcaatgaatgagaattttagttgctctacatcctcatcagcacttagtatttcatttgacagagtctgtcatccaagctcagtgtcattagttattcagaaaattcagtgcagtgttgcagtcctagatcactgcagcgtcaaactcctgggttcaaactattctgcctcagctttgtgagtagctgggaccacaggcgcgtaccgccatgccccactaattgtttttttgtttgtttgtttgttttatagagacagggtctcgctatgttgcccaggctggcctcaaactgctgggcccaaacaatcctcctgccttagccacccaaagtgctgggattacaggcgtgagccaccgtgcctgcccctacctctcactttctctgtctctatactgccatactcctcttctcttcccttctcttcccttctcttcccttctcttcccttctcttcccttctcttcccttctcttcccttctcttcccttctcttccattctcttcccttctcttcccttctcttcccttcccttcccttcccttctcttcccttctcttcccctctcttcccttctcttcctttcctctcctctcctctcctctcccctcccctcccctttttctttcatcttgctctgtcgccacccccctcctcccgctttttctttcctctcgctctgtcacccagctggagtgtggtggcatgatcttggctcactgcaacctctgcctcccaggttcaagctattctcttgcctcagcctctcgagtagctgggattacagacgcctgccaccacacccggttaattttttgtatttttagtagagacagattttcaccatgttagccaggcttgtctccaacctctgacctcaggtgacccacctgcctcagcctcccaaagtgctgggatgacaggcgtgagccaccacgcccggcctcttggctctttttaaatcattcattcccaactccttcatttgctttttgcagtcctatcttctgttctcagcaaggctagctttctttttgatgtttctggaatgaccttctcttctgagatggttatttttaaaatcccttctttcctgagctctgccagtgtcgtctcctctggctgtctcagtgtcttttctttgaactattacatctttgctttgatctcttgttttaaaattcattaagccctttgacttctttgttgttcatgattatcatctgtttcatgttagcttttttatttttctttttttggtgattgtctttcatctgccatttgtttttcctgttccctgcctccctctcctgcttttttcagtaatatatttgtataagtcttgtgttatttcttttttactataactcccctttagatgaagtgagttcttctggacaagctgcttgtgggattgtgtgtggagaaaggactagagtagaattccaggctggcaggaattctcttggcttcatagtgaagcttcttctgacagggttttttgtgagtatgtgaattggtttagccctctcctcttccgatcagttggagcttggcagctgtagggctataaaaatggaacatctgtgtgtttccctggtcaccccactcccctacttctccttggtcccagtgggaccagagaggctcccagagccagcctgtccatcaccatcccaatgttctactgaaggtgttgtgagttgtgccctcaaggtgtagcccgcttctttggagaagtacgagttttgccagctctccctaaggcctgcagccatagcgttctctattggcattaaccttctggatcttctcagcacccctcattgccgcacaggctgatgtgatagcttgctactctcagcaccgtcaccctctggccactggagtgcttaacccagaaaggctgggaagttaatgcctccaggagcagctctcaagtggacaattctgaggcatgctccctgcagtctttttttttttttttttttgagacagagtcttgctctgtcgcccaggctggagtgcagtggcacgatctcggctcactgcaagctccatctcctgggttcacgccattctcctgcctcagcctcccgagtagctgggactacaggcgcccaccaccacgcccagctaattttttttgtatttttgatagagatggggtttcaccgtgttatccagggtggtctcaatctcctgaccttgtgatccgcctgtcttggactcccaaagtgctgggattacaggcgtgagccaccgcgcccggccccctgcagtcttactaaggtccccaggacattggagccccactgggccataggggtgacatgttcatgcacctctgtcaaaaaacaaaaatttatagaagatcctgtgattattctccttagctatgttaacataatgaattatgtttatataattaaccatctttgcactcccagaatgatatgttatttttacaggtactgctgaattctatttgcttatattttaagattttaagaacaatatttataaatgagatgaatctgtagctttctttttttgtgcaacctctattaggttttagtgtcagtgttctcagttcattacaataatttggtagttttccttctttttaggctctggaacggttgaagaaacattgaggttgtttggagttgcctgtgaaacctttaggaccagctgcttttttctttttaggtggtggtagtggtgagagacctcttttacagcttctctacttctatgacaattaatctatttaggctgggcgtggtggctcacatctctaatcccagcactttaagaggctgaagtgggaggactgcttgagcccaggagttcaagaccagcctgggcaacgtagtgagaccagatctctacaaattaaaaaattagtcagtcatggtggtgcacacctgtggtcccaactacttggaggctgaggtgagaggatcacctgagtctgggaaggtagaggctgcagtgagctgtgatcatgccactgcactctggcctagggcatagagtgagaccttgtctccaaattaaaaaaaaaaaaaaggaaataaaatcagaaaattagtctacttaaatggtttcggccggtcacggtggcggatcacttgaggtcaggagttcgagaccagcctggccaacatggtgaaaccctgtctttactaaaaatacaaaaattagccaggcacgatggtgggtgcctgtaatcccagctactcaggaggctgacgcaggagaatcgcttgaacccaggaggcagaggttgcagtaagccagggtcgtgccactgcactccagcctgggcaaaagagagactctgtctcaaaaataaataaataaataaataaatagtttctattggggtcactttggtaaattattttttcctaaaagattattcataaaaatctagtatttaagtgttaaaagactcattcaaattcctaaaaataacctctgttgaaacatgtcagtaggctagctatgggcggtgaactgccattttgcaaccactaaatagagaatttttgacctgaaagaggccctatggatccatactgggggttgcaaacaggtaacatgcctggcagatgacttaattgtgtgaggtgaagactttggtgaattacagagccaatacctcaactaaagacaagcaagttaattttgagcaatatttaaaccaaaacactatgcaggtcaaataaaacagtctgcaagttcacttggcacatcacgtgccatagctagtttatggcctctgccagcccagcctccttcctcataaccacacctcctgagcatctcacgttttagctatgtctcatgctccctgaacagaccctgctctttcttcatatatctttttttctttttttttttgagatggagttttgctcttgttgcccaggctggagtgcagtggtgtgatctcggctcaccacaacttccgcctcctgggttcaagcgattctcctgtctcggcctccctaatagctgggattacaggcccgcgccaccatgcccggctaattttgtatttttagtagagatggggtttctccatgttggtcaggttggtctcaaactcccaaccacagagtctatctctgtcacccaggctggaatgcagtggctcaatcttggctcactgcagcctctgcctcctgggttcaagtgattcacctgcctcagcctcccgagtagctgggactacaggcgcctgccaccacgcccggctattttttttttttgtatttttagtagagatggggtttcaccatgttagccaggatggtctcgatctcctgacctcgtgatccacccacctcagcctcccaaagtgctgggattataggcgtgagccactgcacccaaccacctcttcatatatcttttttttttaagagacggagtctcactctgttgccaggctggagtgcagtgccatgatctcgactcactgcaacctctgcctcccaggttcaaacaattctcctgcctcagcctcccaagtagctgggactacaggttcccgctataaagcccagctaatttttgtatttttagtagagacagggtttcatcatgttggccaggatgatctcaatctcttgacctcgtgatctgtccaccttggtctcccaaagtgctgggattacatacgtgagccaccatgcccggcctcatatatctttcatagctttattatagcaagactttctctgaggattttacttccccaccatattgtgaactcctggtaagcagggaccacatcttattcaccttcatatgctttgtaagcatttgttgtatagcttttataatcagcaaaacaataagaatcttctctctccctctctctctttttttttttttttttgagacggagtctcattctgtcacctaggcttgagtggtgcaatcttggctcactgcaacctgcgcctcccaggctcagatgatgctcccgcctcagcctcccgagtagctgggattacaggtgcatgccaccacactgggctagtttttgtatttttagtagatactgggtttcaccatgttggacgagctggccttgagctcctgacctcaggtgatccacccgcatcagcctcccaaagtgttgggattgcaggcatgagccaccgcgcttggccgaatcttctcataaattgtttgtggaattgaatcgaactccattttatacattatgaaaatgaggccccaagtagttaagtgacttacctaagatcacataggaataggaccagtgctctttttggcattctaccctgtaatagttacagttataaaatcaggaactgtaagagaaatgaaactttcttagtttctagaactgacttaaatgtgtgactctgaatccccagcccacctccttgcagataattgaatttaggatgtcttcaggtaaattgagatccaatccagtaattttgagtggatataatttcaggcttattgattcatcttgggcccattcatagctctccaaacttcctgcttcttcttccccaaagctgatctaattcctagagaaattgtacaaccacagctggcaagaggtgaggttggcagtaaacatttttggggtctcatcaggtcgtactggcatcatctgatgccccttgtgagcctggatactttccttgtcactcttggatcctcaggcagttcagaggactgacgggacacccttcctgcctatagccatctcctaccatctctcttgctttctccaggcccagttgtttctttcagaagccccctacacttttgaaggggatcctcttatatttccttccttaagactaggtttgcagtgggggaggcaaaaactccatacctcatctctctgtctctctttctaaaactttctcttctttctctctctgaattctttacatcttttctcatggtatgggggaaaaaccagttttgtcccttctcacctctgtgtgtgattactgtcccaccccaagagtggcctttgtctttcttctcagctgtccagccatctttgctgaactcagtgtccttctgtctacctatcagttggaggagagttaacagatataccccacgggataggaatggcagagcaggtgatgcttgaaatcacagttttctactgaggatcctggtgcaagagcaaattgagatactcaattgtcatctttaatagaaaaaagcactttagagcctatatttttctatatctttagaaggactccagagatttgagttctagtcaccaagttccattcaatatttgacacttgatttgggtgaggtcttctgttttgctgagttttttttttattgtcctgatttaaccagacttatgggacagtactatgcacccacgttccagggcctccaagttctaagtctcagagtggtccctgggctaaggtgctggatgaacctactcccagcctagaagcctcccgctgtaacaaagtacacccatttttctatgagatagagaatgagttatctttttaaatcatctttttcttctttctcttttgtgtttttcttctgttccccacttcctacttagctgattagaaatgcagttataaccttttgctttcccttcaccagacactcctagagcaagtgtatctgtgtgcttacttaaaagctccagagtagaaacctctcccaccagattgccttgagagacaatagtcaatttacaaccaaaagtatgcctgccaggaaactctgccccacctggagagtatctcgagacaaggccactttacaacctagttctgcccaagatggtggcagctcgaccaggcggtagataaggcaccaaagtgagtcatggagactcccacctgctcattccctcctctgcatgccatttatgccaattccccctcccgcttttttttttttttttttttttttttttgagacagagtcttgctctgtcgttcaggctggagtgcagtggcacaatcttggctgactgcaacctctgcctcccgggttcaagtgatcctcccacctcagcctcccgagtagctgggattataggtgcccaccacctcacccggctaatttttttgtatttttagtagggatggggtttcaccacattggccaggctggaccagaccttgcttctgttaattggatgctacaaatggagagcaagtgtacctgacatttagctacactgctttcttaaaaaaaaaaaaaaaaaaaaggccctggccaggagtggtggtttatgcctgtaatcccggcactttgggaggctgaggtgggtggatcacttgaggtcaggagcttgagaccagcctgggcaacgtggtgaaagcctgtctttactaaaaatacaaaaatcagccgggcatggtggcacacgcctgtaatcctagctacttgggcggctgaggcaggagaatcacttgaatttgggaggcagaggttgcagtgagctgagattgggccactgcactccatcctgggaacaaagtgagacagtgtctcaaaaaacaaaaaagccctatctttgcaggacaggtgagcccccaaattgagacttagcttaggagagttcttggctttgcccaaggaaggaattcaagggtgagccagtggtgttagacagcaatcttttattgaatagtgcttctccttgtggggcagggctaactcatgggcaatgaatccggagtcgatacccagtgtatgagatgttggcaactgtatttatgctcatctctaatcccttctcagccttttggctgagatcaagtgtagtatacgcattcctacccactttcaatcacatgcaaattaaggggcaggctaatgcaaattaaggggcaggttaatgcaaattaaggagtgggtttttagagttttctaggaaagaggtagcaacttcctggtcattgccaagacatttgtacactgtcatggcactggtaggagtgtcttatgttaatgagggatggggacagctagggggtcctagatcctgttttggtcagcagggttgtgccattctcctgtctcaccaggactctggcagccatttagctactttgagccccagtctcctatgtatggagttgagtaaaagtttgggtggttgtgaggattagctgagataatgcctgtgagtatcccataaatgttagactcccacattccaatccctgtgtcccctgcctccagaatctttcattgtgaccttaggagattctgagaatgatttttctcagagcagggcttccagtagctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactggtgaggaggggcaagggccctgggagggaagagcagaagactgaacagacaggtgttttgaggaaggtcgatgcaggtgtaggaggggtcttggatgaatggtggccatcctgtaccttttggagtcacagcatggcacaaaggagggacccctgccctgtagcctaccagccccccacactgggcaagccataagccacactcagagccactgagtcctgttctgtacccactcttcctgctattatgagatccagagagaacgagggaggatagagtcagggtagcaacattgagtcataggttaagcttgtgaactctggagccagactacctaggtttaaatccctatcacctattagtcatgtgaccccaggcaagttgcttggtttgctgtgcctttattttctcctctgtaaagtgagatgataatactagtacctactgcataaatttactgattaaatgatttacatatcagaatagtgctttggataatgcctgacaatagtaaattgtactcagtaagtattaattttattcataaagtacctttccccatatttccatagatatctaatttttaagaaatagaacattacaggtgtagggaaagctctttaccatcccatgcccctttatttctctttaatagtaaccactttcctgaagttggtgtcacccttcctgtttatatttttatatattatcacatgtgtatgtatccataaacaatatatagtatgtggcacactgtttaaaaatgataccataaatagcatcatagttcttttttcccactcaaaatcatttcagctttatccacattgacacacacagacttagtgctgtgttcaatcctgtgactgaaccataatgtattgatcccttcgatccctactaatgaacatttgttttcagccattcactgttacacacaatgttgccatgattaccctcatggctatccccttgtacatgtatgtttctctgaagaggacatataaagtacatacaattcttccattgtgaagtacacacatcctcaactttatataatgttgccaaattgctcttcaacatggttgtaccatgtttcccagttcccagtgataagtgcaaaatagtatcatgttattactttaatttccatttccattatttctagcaatgttaaaaatggtttcacaatttggctggggcatgaaggctcatgcctgtaatcccagcactttgggaggctgaggtggaaggatcacttgaagccagagttggaaaccagcctgggcaacaaagtgaaaccccctctttacaaacaatgtaaatataaatacaaatgaataaaaacaatattttcacaatttataggtaatttgaactttccctttgaattacctttgctcattttgctattgggttatttgtatttttcttttgatttgtaggattacaaaaaataaattttggatcgtaatcctttgttgattatatgcatagtaagtatatttttccagtctgtagttcgttgtctcactttgtttatgatacactttaaaaagaacattctcttttttcctttgtttgtttttatttatttttttgagacagagtctcactctgttgcccaggctggagtgcagtggcgcaatttcagctcactgcaacctccacctcccaggttcaagtgctcctggtgcctcagcctcctgagtagctgggattacaggcgcccaccaccacgcccggctaatttttgttttttttagtgcagatgggatttcaccatgttggccagactagtctcaaactcctggtctcaagtgatcagcccaccttggcctcccaaagtgctaggattgcaggcatgagccattgtgccagagctgtttgtttgtttgtttgtttcattttgttgttgttgttacagggtcttgctctgttacccaggttggagtgcagtggcacgatcatagctcattgcaaccttgaactcctgggctcaagcaatccttctgcctcggcctcccgagtagctgggactacaggcgagtgccactgtgcctagctaacgatgtacttttcaatagaagttagtaaacagagacttttatttagtttttgcatttttttctttttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtgttagccgggatggtctcgatctcctgacctcgtgatccgcccgcctcggcctcccaaagtgctgggtttacaggcatgagccaccgggcccagcctggctttatgtatttgtatatgtgtttgctgaattgtttgaaagtaagctgcatactttatgacatatctttcttaaaaataatgacattacccacataaccaaataccactatcatactaagaaaatcggcactgatttcctaatattatctaatgtacagtcatattcaatttccttatttgtccctagagtgcctttgctctgtcacccaggctgtagtgcagaggcgcgatctcagctcactgcaacctctgcctcccaggttcaagtgattctcctgcctcagcctcccgagtagctgggactacaggcaagcaccaccatgccaggctaatttttgtatttttaggagagaaggagtttcactgtgttggtcaggctggtctcaaactcctgacctcaggtgattcacccgccttggcctcccaaagtgctgggattacaggcgtgagccaccgcacctggcctagggtgccttttatagcttgttatcatgaaccaggatccaatcaagaagcataccattggtatgtctcttgaatctttattaatctagagcagcccccatgccttgtttttttcatcatgaaattgactttttgaagaaactaggttcattgatttatagattcttctacatcctggatttttccctatcttctgtattcacttgttctcagtctaattccaaattcctggggaaaaggtagggtggcccatcttggattaggtgttatataagttttctatggctgccataacaaattaccacaatttgatggcttaaaacaaagcaaatttattatattacagtactgtaggcaagaagtctgacatggatgttcttgttctaaaatcaaggtgtgagcattcctttctcaaggctcacggccttttctgcttctaaaggccacccacattccttggcttgtgggcccttccttcatcttgacagccagcagtgttgcattcctcttaccattattccctcagatctatctgattctaaaatccaggctctgtacatcatacctatactgcctgcaattagtcgtgccacttattttgtggatggaattgaaggatttgacatttagctggtttgctggtgcataacaactagcttctggggagagatgtcctgactagtagctgccaatttctatggcataagtactcctaccatggccagttttaagttaccaacttaatttcagcaggcttgcaaaattcctgaaaatgtaaccatcactccagcacactacagcacactactgcatttaatcctggtaaatttcaccttgttcagcaccatccagcctgctgttgactgttgagaacagatggtttctattgatcttgtttgctttgtttccatagggactgtaccagctcgccatggatatcatcataatgatccgagtgtgtaaaatgttccgccaaggcctcaggggattccgggaatatcaaatcattgagactgctcactggaagcaccctatcttctccttctgggatgtaagcagttgggctcagcaggattatgagggctcaaagaagcccaataaattgcatcccacttcctggcctaagctcagaactgagaaagaagacaaaaggaaaagcagatgagagacccaatggtcacttttattaatggccatacttctgttggagagggtgacttacatcatcaaccaagaggtttacctaatactgaaccccagatttagacagccttacatgcctagccacaggcaacgctggaccaaggcaggctccactgcaacagcaggcctgctgccaaaactcatggcagggaaaggtggagcaaaatatgggctgagagggaaggagacaatcatgcctagtttttctctttccaaattcatcaaagagtttaagtcactcctcaatgtaaaaggagagaggccagtagtgttctactaatacacctccctccatgtggaaagaaaccttgggagtagagaggtggtctccatttcaatggtgatcaaaagagccagaagcaatccaggaatcacaataaccagggttttctaaatgcccacacgctctctctattcgcgtctctactttctttcctacacccctacttcggtgcaggggcattttcagggctttgttcactgcggtgaccatgtttcttttatttttttgagacggagtcttgctctgttgcccaggctggagtgcagtggcgcgtcttggctcactgcaagctccacctcccgggttcacaccattctcctgcctcagcctccctagtagctgggactacaggcacccgccaccacacccagctaattttttgtatttttagtagagacggggtttcaccttgttagccaggatggtcttgatctcttgacctcgtgatccacctgcctcggcctcccaaagtgctgggattacaggcgtgagccaccgtgcctggcctggtgaccaggtttctagatttcctagaaggtcccaatttaaaatattttatcccagtggtagatcatgtgcccttctttagctcagaaaagttggtcacccttctgctaacttgttctagttccccagaggtatcttcattgctactgggtgtgttgctcagggcttcaaagtttccccagcaatcacctggacaaatcctgcccatttttctgttgtttcaggaatgactagagccagtccccactcctctgcatctagtgattcactccaagaaatttccctaaagggcttctgacagatagtggccaaagaaagggggatacggggctggtgatgggggaaggaaaggcagccttaaactggtttctgaggggccagcaggtaatataactagtgtgtatgtagctgagtttaagatacagcaggccagctggagaggaaagatacacctcatctaaagacattcagatacaaatattatattttaagaccctgtgctggccaaaccaaacaaggctgcagccctgtggttgggctgagatgaaaaacgaatggagtagaagaactgtaaccaaaagactcaggttagctctcaggaaggacctcctgactctcagggtggcatgtaatggtgatgcaatgggccctggagatcagagggctttggttaccagaagacgtggcctgatgcatggggcagttggaagctaagatgcagagtcacttgttgtcaggggaatgtgaggctaagcctaaccacattggccagccagagtggcttgagcagagcagaagcctctcaagggcagcctataagggtcatagggttgtcaggcggagcactgggcggctggagtgcaggatcaggtggggagccctagactgcttcagtagatgtgtgaatctggatgtttctgagcactgcctctttccttcagtagtctccctgagaagcaccacatggctatgcaaaggataaacacgttgtgggggcgagacgggtctgagtctaaggaacaaatgacatgtggcttgaggccacactccagacacggaattgggtttgctgaaagccttgagttggggtctcagctagaccactgacttgctgtgtgatccttgggcaagttccttcaccatctcagtcctacatggagcttaataaaacctgctttgtcctgatgactaaatggagtaaggcagggaggatacactgtgcttggctcattaaagacatttaacaaaggttggcttcatttgttcctttcttttttttattttttttatttttttttattttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcctctttttttttattttttgagatggagtcttgctctgttgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccaccttggcctcccaaagtgctgggattacaggcgtgagccaccgcgcccagcctgttcctttctttttattcttccttttcttcctcctctatgcttgtttgtttgctgcttttcccccttccttttctctctcctttcctgtttcctccttatcctcctttccttctccccacccccatatttctctgccttcacaataatatgctgtaaatgctggacccaagcctagtgctgagttggggccttcgagcagaggcaggcctgaaagggccggctgctatgaggtttcccatggcttcctgcccaccatggtggtccaggtagacaggagggctctagatgcaaagttctaggggcagtcttgctgattctccctcttctccctgccctctttctttcagaaaaagatgcaaagccgagtcacatttgataccatggacttcattgcagaggaggtatgcatagctcgaaacttgctgtgggggaattttctttctgcaccctggcttggaagaaaccctggctgggtatcagcagagctggtttcagtctaggctctgccaccaactcagcttgtcaccctgggttggccacttcgtttcctcatcaataaaatagctgatctcagtgattccttccagccctggagctccaagactgtgagcatgtaggaaccagctgtcactgcacagttgagcagaaccaatgggagagagttcctgggcttggacccgtgggaaaacagcaggaaaagataaagcagaggatgtgagagtcccagagagaggaagaattcaggtggtgggaaagggctgacctgtgtgaattctggttctaccctgaattctctgagagatgctgggcacacctctcacacctgggtgtcagatacccttaaagagtcttattcaggtgcagcgcagctgttgacactcggaaggctgaggtgggaggatcacttgaggccaggagttcaagactgcagtgagctatggtcgtatcactgcattccagtctgggtgatagagcgaggccccctctctaaaaaagagtcctctcattttgatgagagaatgcttttatatccatgggagctttggactgtgtgacttgttccctgaatttcaatctcatcattgttatcttcttggcttctctccatgatatcctggatattaaatattaaaatccaatttaaaatttaaaagagtctacctatttatagggaacatctgaaattctcaccaatgcagacctgacttgatcctggcttggagtagccacgttgttgtttttttcctcagtggaaggggaaagaaaagaactttataatgggtatcagggccacctgtgcccatctcctgccccacccctttctcttcttggagcccaggtatggcttctgttgcttgcctctcctgggcacagccttatttttcgtgccccctcgtgtatgaagcatactcagttaagtcattcaagctctgtgactcttcagctcttcaggctggctagtgtgtgacactgagcactgaagcttaatcaggctctttccttcaggcaggagaaactaggggcctatctgagagccacagaactctagatatgagggcaattctgtgcaccgcagtagagggcgggaagagggcacaaagggaaaattctttgttatgggcaaggcctataggtggtcctcaaatgaatcatgcctgactctggttccaacacagggaagagtagagagccaatttatcctcccgtctcagccttctgagtagctggcattacaggtgtgcgctgctgagcccagctggaggctcattttaaaaaccagccctttggccagatgtgctagctcacgcttgtaatctcagcactttgggaggccgaggcaggaagattacctgagctcaggagttttagaccagtctgagcaacatgtgagaccctgtctctactaaaaattaaaaaataaaaataattagctaggcacggtggctcacacctgtgatcccagaattttgggaggctgaggtgcgaggattgctggagcctgggaaatcgaggtcgcagtgagctatgactgtgccactgcactgcagtctgggtgacagagtgagaccctgtccccctgcccccaacccatcccaaaaaagcaagcccagccctctgagtgatgctaatgagtatagggtttctttggggtgatgaaaagcttccaaaacagtgtggtgattgttgtacaactctgtgaatacactaaaaaacactgaattgtacactttaaatggtgatttccagggcatgtgaattatatctaagtaaaaatgacatataatatatagtacacacacatgtatagttatataacctgcccctcagcacagcatttggattctgatggacaactaagcctcagtatagtccatattgggcttctaataacgctaaacttctcacagacaacccttagtattagagaggcttagaatcatagactcaattattgcagcaactgtcagacagtggaaacaatggatacatttacaaaacattgtttagaaaaacactgagtgaagaaaagcaaattgtgcaagtgatgtctacagtcttgacatttatgtaaattttttatttttagtttttgagacagagtcttgctgtgtcatccaggctgaagtgcagtgatgcaatcacagctcactgcaacctcaacctccttgggctcaagcggtcctcccattttagtgccccccagtagctaggactgcaagtgtgtgccactacgcctggctaattttttttttttttttttgagacggagtcgagctctgtctcccaggctggtgtgtagtggagcgatctgggctcactacaagctctgcctcccgggttcacgccattctcttgcctcagcctcctgagtagctggaactaaaggcgcctgccaccacgccctgctaattttttgtatttttagtagagacggggtttcaccgtgttagccagggtagtcttgatctcctgacctcgtgatccgtccgccttggcctcccaaagtgctgggattataggcaagagccaccgtgcccggcccaatgcccagctaattcttaaattttttgtagagatgagggtcttgccatattgcccaggctggtttcgaactcctgggctcaagtgatcctcctgccttggcctcccaaagcactgggattacaggcatgagccactatgcccagcagtaaattttaaaatacaaaatagtcttatatattctgtgggtacatatatatgcatacataaaagtggtaaactcagatggtggggagcagatctggattggggtggtgtatacatataagaggattttaactatctgtgttgttctgatttctaatggaaaatatgtgttatttctaaaaattttacttacacctaagaaaaatagaggaagttattatgccagatgttaatggctaattttgggtagtgggattatggtcagtcattctttcttgatccttcatgtcctctggaggaacacagtaggggtgtggctggcctgcagtgagtgaagggaaaatggtgagaaatggtgtttgagaagcagacgggccaagtctcctatgccctatttgaagtgtattcccttttccccatcccagacattttttgagctcctaaggtaggcctagatctgtgtgtggttgtgaggaatattaggctgtgtaacatccccagcctgccattgaggagctaactaggagttatgatgagacttaactagtaagttacccactttcatgataattacattaatccattcactaaggcagagcccttgtaacctaattacctcttaaaggtctcagttttacaaatttttttgtagaaacaaggtcttgctatgttgcctaggctggtctcaaactcctggcctcaagtgatccccctgccttggcctcccaaagtgttgggattataggcatgagccactgtgcccagcgtccacttcttaatagtgtcagaatggcaattatattttgacacaagttttggaggggacgttcaccctatagcaagagcctactggggaaggggctactctttcagctaagacgacccagtggggactcactgagggtgtggcagcatctgagctgagaccagaatgatgagtcagccatgtccacgagaaaacccaggggacaaatattccaggcagaaaaaaacagcccaggcagagacctcaagacagagccgagcttagcacatgccagggacaggtagaaagttccagagtagagaacaaaggggagaggtaggagatgaggctggagagaagccattgagggtgttcacaactcacagtgtcacttcttcagcaggtgggagtggtaggtgaacgtgctggtccatgaggcctggttcactggagaagaaaagctttagctaatagtctctggaaggttcactttgcttgttagtctcctgtagcacactgagctctaggctgagacagaggcaaaggtctcccctgactgctatgtgtatgtgctgagcagactctgcaggaccactggagcccagggaagcctgtattgcctgggaaggtcaatgaacaacacaggtcggggggatgtcagcgttgatatgtgtcagatctcctaatcctgcctgagtttcttcatctgtcaaatggaataacagttcttgggctggcaggatgcagtgagatgggcgtgtaaaatgtttatcccagtgcctgacacacagtaagcactcatcacgtcagccactgtggtacagggaacgggagagtgtacaagcaggactgtggggtgttgcccgctggcccatgggtgaaattgctgggtcccctgtatcactctggtcctctctccccagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtcagtgaggggcacagcccttggccaccaggctgaggctggactgagcaaaagagcctggctgagaaggtgtggcaggtcctgcccacccctctgcataatgtcagccatgaatgaagtcttctgtccattcacttcagctcccactgctatggtcgcagcaccctttatctcgctcacttattgagactcttaattaaagggccattaaatctggagaggatctagtagaaacctcagagaggatctggtccaattccctcatttttcagatgaggaaactgaggctctgtgggggaaaatggctcctcctaggtcacccagacaaaaagaaacagcgctgaagctcttttcagttacgcccatcagagcttgggatgaattctttctgaaacagcttggctttgcttgaattaccactgaggtcagtgatgctctgattgagagttgagaaagggtagtttcccaaaggagaatcagggtgtgattggtggaaaaatatgaccagatgcttgacagcaaaagcgacagatgtctgcttttggagattcgggttctagctctgacttgattgtggcttgccgtgactttcagcaagctgtgggttccttgggtccccctttccccttcccaaaaatgttggttgagcttgatggtctctgagggtctttctggctctagctctagtcatctttacttcagtgaacagtgcctgtgctccctcatcttcaaaatctcatttcctagctgaatattcctgctatctcccagctagtcattatcacctgggccatctcctctttctttattctttttattattattattttttgagatgggtctcgtcctgtcaaccaggctggagtgcagtggtgtgatcacagctcactgaagcctctacctcctaggttcatatgagccttccacctcggcctcctttgtagctgggacaaggggtaggcatcaccattcctggctaattttactttttattttttgtagagacatagtctcactatgttgctcagggtggtcttgaactcctgagctcaagtgattcttccacctcagcctcccaaaatgctgggattacagacgtgtaccaccgtgcctggcttgcctctttcctacattgataaagattccaggctgatactggtttgtagctcatgaagcccacagccacaatggaggctgggcagtactgactccagcctggtgtggtcctctgtctgtcctctgatcccttccctcaggagtttgccacagaatcacaaggccagtgagtactctctaagaggtcagaagaggagatgctgctgggggctgggtcagggaaggcttcctggaggaagtaggatctgagttcctgaaaggatctgaatagtggagaagacagggaaggccattgcaggcaggggagcaacatggacaaactgatggaacaaagtgggtatcatctgccctgagcagggtgttggttcccctgctgctggtcaagccagcgagtcaggaaggagcagaaggtggcagtgtggagggggaggaggaagaggaggaactgctgagggcagggccatgagctcagagctggggacaatggccctgctatcggggcacttccacaatggctgctcatcagtcctggcagagactaaagggcagacttttttttacccattgtctcctgggtaaaatccaaacttagctgagctttggaggccctttatggtgggaccagtcgaatttctctcccaccactcccctgacttgccttctcccattttcctttcccgtgaagtgcacattacctatgaagtacacgttatcccttgaatgtgccgtgctttgggccacctctgcacctttggtcatggtggtccctgtgcctgggaccctcttccatctctttgtccacctggatgactcacttcaagcaccatgctagagccttgtctgaccttcctaagcttggataaaggccccttctctgtgctcctcaagtagcctgcactgacatctcttaaagcatttttaaaccttatttacatcctgtatgtgaccataattttgaaaacaaagtctgtgttgttcattgtgcccaatttttttttttttgagacagagtcacccaggccagagtgcagtggtatgatcatggctcaccatagccctaaactcccaggctcaggtgatcttcccacctcagccttacaggcagctgggactacaggtgtgcacccccacatttggctaatctttgcattttttgtagagatgaggtttcaccttgttgcccacccaggagttcaagaccagcctgggcaacataacaagactccgactctccaaataatagaacaattagctggatgtggcaacttcaggtctcagctcaaatatcccttccttattgatagtaatagtaagaatagctaacatgggactgggcacagtggcttactcctgtaatcccagcactttgcaaggccaaggtgggaggatccttgagcccaggagttcaagaccagcctaggcaacatagtgagaccctgtccctatctcaaactcctaggctcaaatgatcctcccaccttggcctcccaaagtgctgggattaacaggcgtgtgccaccacacctggcctcacggtacctaacagacaccactgatatttatttaacttattgaatgaatgaaggaaaagaataaatatcgaaagaattgagatttggacttgcatacgaaatacagaaacttccctctgagtttaagaactccttgttcgctctgggcctgggcacctctaccccaagggtgcccagttgggtagtgggctgctggtaattatgataagaccattatctgtgtctcattctaggcatactcatctgcattttacagacaagagaaaccaaggatcagagaggggatatccattgctcagtgtcacacagctaagagcagaaccaggatttggatcctgggctaacgctaaagccagtcctcctaatcatttagtgactctactaacccattcattgctttcagcatgtgttcactcatttattccactatgttcaatgaacattcactgtgcccaagcacacgcagcagtgacccagactggcaaagactctgctctcaggaagcttcagttcaaccgaggcaggcaacgggataggtgttagtgaaaggctccagcttgactggcagggctgggctgtcctgagggcccttctggtccaagtctgtgctcttatatcccaaagcaaagagcacaaccagtccagagctcctctcagcttggacctgcccccatgtcactacccaatcaactagcagtggtcttttcccaggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggtaagcccaggggaaggacccagtttcctggggtggagtgggtggaggtgacaggacttctgctagaacctctcagccaggcccagtcctgcctagtactctgtacaagtcagtgtcccgtgtgggccccttacctgtcaaatgctaattgagttggactaagatcagcctcttcatctgtgatgtttaagaagtatgttcctgatacagccctttagagatgaagtgactccatagtgaggcctctccagcttcctcccctctggcctgttcaggtctgttgcctctttttccataagcagcagattaagaagaaggggagtgggccccagtgggagaatgtgcaggagaatagaggaggctagggaacacacagtctggtgaggagagaattcagggggaagatggaggcacggaagatgtgtgtaaggctgaggacaggaagtggaggtggcctcacacttgcccttgccctgtccacccaacaggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggtaactctgccttcattcaacatttttttccccttgtgtgtttattagctgcctgactttgtctgtcctaggcctggtgggaaacatactggttgctgttctctctgtctgggatgctctgaagtcccacctcgtacccaccttctctctctgcagactcctactatcccttcgggtctcagctcaaatatcccttctttattgaaagtaatagtaagaatagctaacacgggactgggcacagtggctcactcctgtaatcccagcactttaggaggccaaggtgggaggatccctgaacccaggagttcaagaccagcctggacaacatagtgaaatcctgtccctacaaaataaaaaattaaaaaaaattagctgggtgtggtggcacatacctatagtttcagctacttgggaggctgaggtgggaggatcacttgggcccaggagttcgaggctgtggtgagttgtgatcgcatcactgcactccagcctgggcaacagagtgtggtcctagtagctaggactgtaggtgtgctgccacatccagctaattgttctattatttgtagagatggaatcttgttatgttgcccaggctggtcttgaactcctggtctcaagtgatcctgccactttggcctcctaaagtgctgggattacagacatgagcccccatgctcagcccaaactataaaactataattccttttttttttttttttgagagagggtcttgctctgttgcccaggctggagtgcagtggcatgatctcatctcactgcaacctccgcctcctgggttcaagcaattctcctgcctcagcctcccacatagctggaattacagtcatacaccatcactcccagctaacttttttgtatttttagtagagatggggtttcactatgttggccagggtggtgttgaactcctggcctcaagtgatctgactaccttggcctcccaaagtgctgggattacaggcgtaagccactgcgcctggcccaaactataattcttgattgcatggtaatttctttacagtttatataccccctcagacagtaagcagtatggtgacagagaccagatagatctgtctttgtcactactataatccttatgttgtcacactgccagacacatgcaggtgctcaacaaataaatattgagtaaggtgaataacaggatataaataattacaatcacatgtgagtcagaaagtaagcaccgtaactgggtatcatatttaaaagcagaactcatacatagcaaaagatttttggtttttgaatacttatgtgcatgaaaggccacgtaaggatatgcaagtgaaatctcatttaattgctcttcagttatttgcctttatgtaaaaggaataaaaatccaatgaagtatctgcactggccctgaaaatttgggctgtagggctgcacagctacagagaagtgtgatggccgaggggtctggttcctgtggctggggctgagagaggtagcttcatcccctggaaaagtggggatttagtcctaaagggaggagctgttttttttttccatactgtggaaaaataggtctggctccaatctcagctcttaggttaccagcgatgtgaccctagataggtcacgccatttctctgtgttttagcctcctgctctgtaaaatggggataaggatacccttctcccaaggtcatggtgaggatggaatggaatgatcatgggaagtgtatggcccagtgcttggtgcgtggtaggtacttcttctatggtggccctacttttcttctggtgtcttcagaccttcgtccctgacatggcactgagcgtgttcacctctggtgccctgaccttaactcagtgcgcgcattgaggcctgagtcaccttgagttaacctgattcaatgaactcagtccacctgagtcagttaagttctgagcccttaacctgttggaggtgagaaaatctgagatgattgttggcagcacttggagcagcatatgaaggcaggcaagcctgtgaacgtggtgttcaaggtcaggggaaggggcagtcacagtggggtgggttcacccacagggagcaacaggcagaaagagtggagtccagacatgtcccactctccagacccagagctgaggatttgaagccaacaggccagggggacacaagggttggatgagctgcccaaagcaaaggtagggccagaaccgctaagttgggggacagagcagctgtgagctggagtggggactagcttcatgagccacggtggggagggatggcagggctggaggaggagaagattcttggaaggaggagcagaggtgagaaaagcacagaggctggatcacccaggggcatctgagcagcagtaaagaggggagcttggctggaggggagggccttgggaaaaggaggagggagccaaggtgatagcaggtaggagaatggctacaggcaaggccaggtaattgggcaggtagcagcgaaatcttccacccaggcatcctccacaggagaagagtatgtgccctctgcagattgctaaggtctgggcaccttgtgtgatggagttgatgaattctaacaggctcttcccacaggaagatggagctgtttgcatcatggtctgatgagaagctctggcagctggtagccatggcgaagatagagaggttctcgtatgggcagctgatctcaaaagattttggagagtcacccttcatcatgtttatcagcaaggtgaaaagtctgggggttgggatgagggtgaacctctgaggagcatgcctaagatcatgtcctgtgacctgatggtcagagtttgagcccttttctgcaacctgtgcaattcacttccttctcagagtttccatgtcccagctgtaagaggcctgcctctcacagagcatggctagagacattagatatatggctattgtgttagaaagaggaccaagggattctcccgccttgagctcctaagcatgcttatttacatatagatgcatatttaaattatgcatttggctgttgaatcttagtgatgccagatcacttttaaatttatttatttatttatttatttattttgagacaagagtctcgctgttgtcagcccaggctggagtgcaatggcacaatcttggctcactgcaacctctgcctcctgggtttcagcaattcttctgcctcaccctcctgagtagctgagattacaggtgcctgccaccatgcccggctaatttttgtacttttagtagagacggggtttcaccatgttggacaggctggtgtcgatctcctgacctcaggtgatctgcctgcctcggcctcccaaagtgctgggattacaggcatgagccaccaggcccagcctatttatttttgagacagagtcttgctcactctgtgccccaaactggagtgcagtgacgagatcttggctcactgcaacctctgcctcctgggttcaagtgattctcctgcctcagcctccagagtagctaggactataggtatgtgccaccatgcctggctaatttttttttgtatttttagtagagatggggtttcgtcatactggccaggctggtttcaaactcatggcctcaagtgatctgcctgcctcagcctcccaaagtgctgggattacagatgttagccaccacacccaaccttaaattatctttaaattgtaaaagtgatatgaccacattaggaaactttctggaaaaagggaagaaatcatccataaacccatcatctcagagtagagtttcaaaatggaatttcttggtatcatgattttgttttgtaaggcagactttattcaaaggggccatagccataggtatagggaccactgcaatggagtcttgcagccagagacagagattggactcaactctcagtatcgtaatttttatggctcctgcaacaaattgcattccaaaaggagagccccaccttatctagtgtccaggatgtacatttttgttggtgccatcacagctctgccagccttgcatgtcattttttcaaaagttttctagtttaataggtcgcaattgctgccatactgaggatttgatattttttctgattactagtgagatttatcatgtttgtttatgacctacattttatcttttgcaaattgcttcacgtcctttgccaccttctctgttggttgataatgaaaagaaaatctcccatttctcaagtgcttactgtatgccaggttctatgtttcacatgcttcatctcattttagtctctatagcccggaggaggttagtattgtcattattcccattttacagaggaggaaactgaggcacagtaaggtgaagtggttatccaaggtcacacagctgatgaagtgcagaggcagggttcaacccaagtctctctgactgcaaagatattttcaagaacttggatttaggatttgggctgacctttctgtctggttcttacagattaagccaccacaggcatttgttgagtttttgccaaggtcatgacacattggtccaggctctggagggatacaaagatgaaaaagactggttttctctctttatagatctcctccaccagattccacacatagacaaagaaaagtgtcaatgccaagtaccaagtgattggtgcaaactctgcaagttacaagatttcaggagagggaactctctaaaggctggaggctttaagaagggcttcctggaggaggtgaggtgggagatgagccctgacatattgaaccattaggcaaaaggaggaagcaagattggttgtgtgctggcactggcttgtacctgcctatgagagctgattgttaaattttcaggaattttggtaaacatagtaattattacaaattagatgctataaacctacaattaaataagttatatggaaaattaggagctgggcatggtggctgatgcccatagtcttaacgactcaggagactcatgcaggaagatcatttgagcccaggagtttgaaagcagcctgggcaacatagcaagaccctatctctaagaaagaaagacagatgagagagggagagagagagagagagagagagaagaggggaggggaggggagggggaagaaaggaaggaaagaagaaaggaaggaaggagcaagcaagagagagaaggaaagaaagaaaacaagggtaatacatactgaaaactcatcatttcctactgatgttactgcatttttactagtttttctcttcaggttacgtctattgtgtctctatggtagaaatactatgcaattgtgagcatctcttccccactccacattcagtgacctcatgttggtagcttacaattagccatggttggataatttatacaatggaatcagcaaacaccctaagtcaggtcttggtttagggctttgctgattgtcttaggaaagtgataaaagaaaatgcttataatgcagattaaatttaaaagtggcttgggtctatagctgctacactgcaaagagaatgaaatcgtctaacaatatttaaaagctattattgctccgggcgccgtggctcacacctgtaatcctagcactttggaaggctgagatggatggatcacttgaggtcaggagttcgagactagcctggccaacatggtgaaacctcatgtctactaaaaatataaaaattagctggacatggtggcgcatgcctaatcccagctacttggaggctgaggcaggagaattgcttgaacctaggaggtggaggttgcagtgagccaatatctcaccactgcactccagcctgggcaacagaatgagactccatctcaaaaaaataaaataaataaaaacaaataaaagctattatctggctgggtacagtggctcacgcctgtaatctcaacactttgggaggccgaggcgggtggatcacttgaggccaggggtttgagaccagcctggccaacatggtaaaaccccatctctactaaaaatacaaaaactagccaggcgtggtggtgtgcacctatagtcccagctactcaggaggctgaggcaggagaatcacttaaacctgggaggtgaaggttgcagtgagctgagatcatgccactgctctccagcctgggtgacagagtctcaaaaaaaattaatttaaaaaaaaagctattatctcattcatcatagaagttataccattgaacaaatgaagttctgatgtacatagtgctaaagctaaaaaacatttcagtttaatataatttatgtgagggtgagaaatagaacagtatatcacaagtcagatttaataacattgaatttattgggaagagaatggattgggatgcaacttcatttgtccaatcatgtttgagttgcaactataaactggccatggatacaagattcagccaaaacccacaaaagaattctgtgagagctgattggctgtatggaatttcctgtatggtatattttattatttataaattgtgtgtaacacattctgtataacaggtttatatgcaggcatatgttttttaggagagctggttgttaaacttaccagcaccaccaggggcgtggtgtgtgtgttgttattctcggctcagtcccagagaacagaatcaagtctagttaatataagtagcaaaagatttattgccagatatcaattggcagttccttctcctccttgatatttgcttcctctgtgctaaaattttgaggtgatcacctctgccatatctctccaaatttaactctaagctctttgatactatatagccagaaaagatggggggatgtgtggtgagggatagaaatcctttacaatattttctttaatcagcataatgattacattctgactggcagaaagcggggggtggttcttcatctgttttgcctccattgcttcacctgtgaaatggtaccaatcaccccataaagtctggtaaggatgagaatcagtttagtacatgcttactcagtgagcattcctcccgcaatccagtgcttctcaaagtgcggtggctggaccagcagcaccagcagcacttgggaactcatttcttcttcttttattttttttttttgagatggagtttcattcctgtcgcccaggctggagtgcaatggcacgatcttggctcactgcaacctccacctcctgggttcaagtgattctcctgcctcagcctcctgagtagctgggattacaggtgcccgccaccaggcctggctaatttttgtatttttagtagagatgggatttcaccatgttggccaggctggtctcaaactcctgacctcaggtgttccaccctcctcggcctcccaaagtgctgggattacaggcatgaaccaccgcgcctggcggggaactcatttcaaaatgcaaattctcaggcccacccaagagctactcaatccaaaactctaggaggaagggctcagtgatctgtgttttaacaaggcttccaggcgattccaatgcacactgatgtaggagaacccctgacctaagggaggaattttcaaattttggtaagcatccagacatgtagggtgcttcctgagggaggaattctcaaactttggtaagcatacaaacacatagggtgctttttaaaaaggcagatttgctgtctcaccccagagattgattcattaactctggaatctgcatttgagcaagtgctgtaggggattctaatgcaggggtgctgagccttcattctgagaaaaataatgcggaagtcactaaaggacagcaaggtagggagctcttggccagaagatgaatctggtttgttccttacagtgttttattaaaatctgatttaatcatcaatgtgaagattttatataaaaattctgatttctggcttttgagaattcagaggatcaggcaacaacaagccatattttggtacagcaccccctcccccaccccccgaccctggttggaaatgaaaagcaccagccccctctaaaggactgctcttttctctctttttttttcctgcctggccagcgttttttgagtgttcatctctgggagggagatcaagctgtcccgactcctgtagtttactcatattaccactagagggcaaaatcagctgcgggtggctggacacccctgggacctcagaaagctagagaagatttcctgatggcatcgaaaacttaatgcacactttcaactcatttctaacagtttatcactgggggacacatagtggaactgttctctccatagatgcaattaaagacctactaaatacttgaggaaaccgggctcatgttgtttctctggcacctgcagttcccctatagctcaaaaaaaagaaaaaaaaaagtatgcagtaaagatttcaaatctaaactttacagcttcataaatttttatatatgtatacacctgagtgatcattacccaaatcaagataaaaaacatttccactactccagaaggctctcctgtgctccttcctagacaaaatccccccacaaagcttaatactcttaagacttatgtcaccacaggttacttttgcatgtttttgaacttcatataaatggaatcatacagtgtgtattccttgtttctgacttcttttgctcaactgaatatttgttatttttaattttataaattatggtgtgcatagaataatatgtgaccattaaacatgatactatagaaccatattgtttggcatgaaaagaggtatttgatatattattgagtttcttaaaaagttacaagagtctgttttatgtaaatgaattcgttgatgaaaaattgtagatatacatcttatatgttcatagagaaaagtttgaaataatattcactaatatgttactactagttatttctgagtgtcaggattaatgtagtttttatctctatgtttttatgtctggtttgaatatttttaaactttcaattttggaataattttaaatttataaaaaaattataagaacagtacaaagaactcctgtagctggaactacaggcatgcaccaccatgcccagctaattcagctaatctttttttttttttttttttttttggagacagaatttcactcttcttgcccaggctggagtgcaatggcatgatcttggctcatggcaacctccgcctcctgggttcaagtgattcgattctcctgcctcagcctcctgagtagctgggattacaggcatgcgccaccatgcccggctaattttgtttttttttgtttgtttgttttgttttgtttgagccagagttttgctcttgttgcccaggctgcagtgcaatgatgcgatcttggctcactgcaacctctgcctcctgggttcaagcgattctcctgcctcagcctcccgaatagctgggattacaggcatgtgccaccacacccggctaattttgtatttttagtagggacggggtttatccatattggtcaggctggtctcgaactcccgacctcaggtgatctgcctgcctcagcctcccaaagtgctaggattacaggcgtgagccacaaggccggcttaatttttgtatttttagtagagacaaaataattttgtgttgccatgttggccaggctggtcttgaactcctgggctcaagtgatcttcccacatcagcctcccaaagtgctgggattacagtccgtgagccaccgtgcctggcttatatttagttcttatgcttcttcagttacttgaacttcgtatggtgagtaaataacattttcatttaaaaaaaaaaaaagaaaaaaaaaaagcaccaggctgggcgtggtggctcacacctgtaatcccagcactttgggaggtcgaggcaggcagattgcttgaggtcaggagttcgagaccagcctggccaacatggtgaaaccccgtctctactaaaaatacaaaaattagccgggcatggtggcacatgtctataatcccagctactcaggaggctgaggcaggagaatcgcttgaactcaggaggcagaggttgcagtgagccgagattgccccattgctctccagcgtgggtgacaaagtgagactccatctcaaaaaaaagaaaaaagaacctgaaaccacttgcattaagcaaataaaacaaaatgggataagatgcaattaagagagattttcttcaaagcctggcctacctggagccttaggggttaacccttttcctatgtcccttgctgtgttcagggcagctgtgaagtcctgcggctgttggaccttggggcctccccttcctaccgtagatggatctggcagcacctggagctgatagatggcagacctctgaagacccacctgagtggtaagctgccttggcctgtctgacagcagggggcgcctgggcctgtcctgtttccagttcccagcacatagagccttagaaatctagtcagccagcctgacagcgtatatcatctgcacccttctaccagcggtggaaacccagtctgcaaggccctgccctcctttccagccttttttttttattgagccttttcccttttgctgtttaggttctcccacgtgaccatcaactccttgcctcacatatcccccaccctttttttcacccagctctcttctgctttttaaaatttatttatttatttgttcattctgtctctggatttgcctgtgatggacttttcatataaatagcatcatacattatttggctttttgcatctgacttccttcactgagcaccatgttttcaaggtctatttatgttgtagcagatatcatttcttcattctgttttatggctgaataatattctaatgtatgcatataccacattttttttgtccacttatcagttggtgaacatttggattgttttcactttttggctgttttgaataatgttgctatgaacatttgtatgcaagtttttgtgtgaacatatttttcagttctcttgggtattacctatatgcctaggagtggaatttctgggtcatatggtatcttagtcagttttctatttctataactgaatatctgagactgggtaacttataaagaaaagaaatttatttcttatagttctggaggctagggaatctgaggtcgaggggctgcatctggtgaaggacttcttgctggtggggactcttcagagtcccggggcagcaaagggcatcacatggagagggagcacttctgtctttgagatcttagactacacattcttccttgaagaagtcttcctggtttctcatgctggaccagatcttccatcctctgctatatgccattctagtacccttcaagtaccattcaagtactcttctgtgttatataaccccactgaaatcatacaactgagtctgaaatgcttattaaacatctgtttcccttgctagaatataagctctatgaaggctttgcattcccagggcttcgtattatgcctggcatctagcaggtgctcagaagtgaattacagagttaatggataaacatattttggctgctgtgtgtggtttggacacatcctaggctgtgaatgtatgcgcactctccacagccttatcccaactcagtaacaagtatgaataacagtgatcatttattgaattctaattgtatgtttattatattgggcttgactgtttatacatattgcataattctcataatagctctctttttgttttttttttttttttggagacagagtctcactctgttgcccaggctggagtgcagtggtgcagtctcagctcactgcaacctctgcctcccaggttcaggcaattctcctgcctcagcatcccgagcagctgggattacgggcacatgccaccatgcccggccaatttttgtttttttagtacagatgggatttcactgtgttggccaggctggtctcgaactcctgaccttaagtgatccgactgcctcggcctcccagagtgttgggattacaggcatgagccaccgcacctggcctaataactctttaagaaggtacgattgtaccatctgacacatgaggaaactggctcatagggcaaataagtagcaatgtaggactgtagagttgggattctaacccaggcacaactggttccaaagcccagactttcttctcttcataaatatctccagccttcttcattctccatttcctgttgttggacatagacgttgtcaagtagcagcctctagaactggccagggtgataaccaggcttgctgattctagggtagtattgtttccattcacagctctgtaatggcatttttatttatttttttccccttccatcctctgcagatctttttgtgtcacccacttgggtcaaggaccccagccctcaacagatatttgcagtggctcagatgtcttatctcttacctcctgctcagtactggcatgcttccccccacttcccttgagattgtaatctgtgtatcctggggcctcctccccaaggattgccttatagatatagcagtcctcctgagattagaactgaggccaacacagggtggcgaggagaagggcggaaaaaggagaggttggagctgaacagagctgggtttgagtcccatttattagctgggtagctttggtgagtactcaaagtctctgggcctggtttcttcatatctaccttgggtagtgtcatggttagcagcataggcttggagtccactgcttctgtttgaatacagggtccttctcttattagtgatgtgatactgggcaagtgggccctatgtctaagtgcaccagtgccctcagagtctgtaaaatgtaaataatggtccgtacctcgtaggattgtaatgacattaagcaaattaatatataaaaactcttagaacactacctggctgcataggcagatggcagatgtttgttatcattaccacaacaggctgctaggaaggcagagtgagatgatgtatgcatgaggccttataagtactcagtaaatgtttcttctcatgtcaattcttgtttgtcacttttccactgtcaatccaccagagaaaaagttgcatcccacaaattttgatatgttgtattttcaatgttattcagttcaaaatacctttaaatttctcttttgatttcttctttgacccatggaatatttagaagagtgtttagtttccaagcatttgggggattatccacctatctttctgttactgatttcttttttctttttctttttttttttttttttttgagagggagtctcgctctgtcacccaggctggagtgcagtggtacaatctcagctcacttcatcctccaccccccaggttcgagcaattctcctgcctcagcctcccgagtagctgggattacaggcatgcaccaccaaacccagctaatttttgtattttagtagagatggggtttcagcatgttggccaggctgggcttgaactcctgacctctggtgatctgcctgcctcggcctcccaaagtgctgggattataggcgtgagccaccacgcctggcctctgttattgaattctaagataacatactttatatgatttgaatcctctgaaatgtattaaaacttgttttatggtccagaatatagtctgtcttggtaaatgtttcatttgcatttgaaaaaaacttgctgttttggggtgcagtgttctatgaatgttaagtaggtgaagttggttgatagtattggtcaagtcatctgtacccttataactttctgtctacttgctctatcaattgttaatagaggctggcgtggtggttcacgcgtgtaatcccagcactttgggaggccaaggcgggcagatcacctgaggtcaggagttcgagaccagcctggccaacatatagtgaaaccctgtctctaccaaaataatacaaaaattagctgggcatggtggcgcatgcctgtagtcccagctacttgggaagctgaggcaggagaattgcttgaacccgggaggcagaggttgcagtaagccaagatcacgccactgcactccagtccgagcgacagagcaagactgtgtctctcaaaaaaaaaaaaaaaaaaaaaaaaaattcttaatagagttgttaaaatctccagccataattatagatatatttttctccttgtatttctgtctgttttgcctcatatattttgaagctcttttattatatgcatagatgtttgggattgaactcttaattattatgaaatgaacttatttgtccctggtaatattctttgctctaaaacctactttttctgatgtaaattcagccacttcttttgatttagtgtagcttcctcttgattagtattagtttggtatatctttttccatccttttgtgtttaacctatttgtgtctttatatgtaaaagtgaatttcttaaaggcagcatataattggatcttgctgaaagacccaatttttattgagatgcctaatcattgacatttaatgttaatattgattatggttggatttgactctaccatcttgctatttttctttctatttgtcacatctattccctttttcttctgtttttccctgccttttggattatgtattttgtataattcaatcttattttctttgttggcttattagctgtttgtggtattattttcacagttgctttatgatcattgtatatacttttaacttatcacagtctacctttaagtgatattataccacttcatgtatagaatcagaatcttacaatgatatatttccattttctcctcctagatattatgctattgtgatatattatactttaatgtatattaaaaaccttaccatacatggttattacttttgctttaaacaagtatcttctttttttttttttttgagacggagttttgctcctgttgcccaggctggagtgcaatggcacgatctcggctcactgcaacctccacctcctgggttcaagtgattcttctgcctcagcctccctagtagctgggattataggtgcctgccaccatgcccagctaattttgtgtatttttagtagagacagggtttcactatgttggccaggctggtcttgaactcctgacctcaggaaatccacctgcctcagcctcccaaagtgctgggattacaggcatcagccaccatacccagcttaaacaagtatcttttttgtatatttaaaaaataataagaaaagactcttatgttaacctacatagttactatttctgatgttctttgttcctttgtatagatccagatttctacctaataaccacttccttctgcctgaagtacttcctttaacatttcttgtatttcagctctgttagtgatgaattatttcagcttttctatgtctgaaaactattttatcttcatttttgaaagaaatttttgctggatataaaattctaagttgacaggttttttctttcactactttaaagatgttgcattaaagtcttttttgacttgcattgttttcagcaaatccgttcatatttttatttattgttttcaacaagaagtccgttaacattttatttatttatttatttatatttttgagacagagtctcactctgttacgcaggctggagtgcaatagtgtaatctcggctcactgcaacctctacctccctggttcaagcgattaccctgcctcagcctcctgaatagccgggactacaggcatatgctaccatacttggctaatttttgtatttgttgttgttgttgttggtttctgagatggagtcttgctcttgtcacccaggctggagtgcaatggcacaacctcggctagctgcaacttccgcctcccagtttcaagtattcttgtgcctcagcctcacgagtagctgggattataggcgtccaccaccacgcctggctaatttttttttttttcatttgtgtatgaaattttttttttttttttttttgatcattcttgggtgtttctcgcagagggggatttggcagggtcataggacaatagtggagggaaggtcagcagataagtgaacaaaggtctctggttttcctaggcagaggaccctgcggccttccgcagtgtttgtgtccctgggtatttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggataagaatttttcttagtacagaacaaaatgaaaagactcccatgtctacctctttctacacagacacggcaaccatccgatttctcaatgttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcctgggcggggcggctggcagggtggggggctgacccccccacctccctcccggacagggcggctggccgggcagaggggctcctcacttcccagtaggggcggccgggcagaggcgcccctcacctcccagacggggcggctggccgggcggggggctgacccccccacctccctcccggacggggcggccggctgggcggagacgctcctcacttcccagacggggtggctgccgggcggaggggctcctcacttctcagacggggcggctgccaggcggaggggctcctcacttctcagatggggcggttgccaggcggagggtctcctcacttctcagacggggcggccgggcagagacgctcctcacctcccagacggggtcgcggccgggtagaggcgctcctcacatcccagacggggtggcggggcagaggcgctccccacatctcagacgatgggcggccgggcagagacgctcctcacttcgtagatgggatggcggccgggaagaggcgctcctcacttcctagatgggatggcggccgggcagagacgctcctcacttcccagactgggcagccaggcagaggggctcctcacgtcccagacgatgggcggccaggcagagacgctcctcacttcccagacggggtggcggccgggcagaggctgcactctcggcactttgggaggccaaggcaggcggctgggtggtggaggttgtagtgagctgagatcacgccactgcactccagcctgggcaccattgagcactgagtgagccggactccgtctgcaatcccggcacctcgggaggccaaggctggcggatcactcgcggttaggagctggagaccagcccggccaacacagcgaaaccccgtctccaccaaaaaaatacgaaaaccagtcaggcgtggcggtgcgcgcctgcaatcgcaggcacttggcaggctgaggcaggagaatcaggcagggaggttgcagtgagccgagatggcagcagtacagtccagcttcggctgggcagcagagggaaaccgtggaaagagggagagggagagggagaccgtggggagagggagacggagaaggagagggagagggagagcctaatttttgtatttttagtagagatggggtttcgccatgttggccaggctggtctcaaacacctgacctcaagtgatccacctgccttggcttcccaaagtgctgggattacaggcataagccactgcacctggccaacatttttatttttgtataaactctttatataaccttgtatattttctgtacacagtgtacctttttgctttggctgattttgaatttttttatcaatagttttaagcaatttgattatgttgtgccttggtataatttttgtcatgtttctgtgcttgaggttcatttagtttctgggattcctgggtttgtatttttaaaatctgatttggaatattttgaccatgattttttcaaaaaaattatttgtctctccctctcctccactttgagaactccaattacatgtatattggattgcttacaatccaatatattattggattgcaacatgtatattggattgctgtgtttcacagctcactgatgttctgttcattttttttattcttttttttttcctctgtgacattttggatagtttctattgctatgtcttcaagttttctaatcctccttctgcattgtctaatctgctgttaatcccacctagtgtacttttcattttagacattttagtttttatatctcaaagtttgatttgggtctttttataatttccacaactctacttaatatacacaatattttttccttggaatataattataatagctcttccaatgcccttatgtactaattccatcatatgtgtcatttctgagtcagtttcaatccattgtttccttttcatatagtttatattttcctacttctttgtatccttcatgattttttaataggatgctagaaaatgtgaattttgagtactgcatattttttattcctgtaaatatttctgaacgttaagatgtagttacttggaagtattttgatcttttcaaggcttgcttttaaatttgttatgtggggtcagaacagtgtttaatctagagctagtttcccattcgtgaagtaaaaccattttgtgtatttcagaatgccccatgacttgagaggttttctattctagttattgggaaaaggactatttctggtcctgtttgagctctgatgatttatccctctaatcatttggggtgattctttccccagccttgggtagtatactatgtaacaaattgccccaaaacttagcaacttaaaataacagacatttacttctcccaatttctgtgagtcagaaatttgggcacagcttagtttggtgcttctgactcaagacctcttatgaaccagctacttgggaggctgaggcaggaggatcatttgagtccaggaattcaagaccagcttggaaaacatagctggactccatctgaaaaaaaaaaaaaaatctcttgaggttgccattgtcagccagggttgtggtctcatctgaaggctcatctgggagggacctgcttccaggctaactcacgtggctattggccaagtgtctggcctcatgggtgtctctacagggcagtttcatgacatgtttccccaagaatgagagagagcaacagagaacatgcccaagatggaagccacagtttttttataacctaatgtcagaaataaaatctcatcacttctgctgtatcctgttagacgtgagcccaacccacacttaatgggagggtattacacaagtgtgtgactagtaggaggtggggttcactggtggccatctcagaggctgcctaccactggtagtttcccaatacacatgtgctgattaatactcagctgagcttcaggggaaactctctgcagatctttggagttctgtctctatgcagctctcttctctctggttccctgctctgtggactctagctgccttgccctcccctgactatgtcttctgtctcatcaattcaaggagattgctgggctccatctgagttccccctccctgcaccatggcccagaaaatctttaggcagcatgctggggcagtagtagggctcacctcatttgttttctgtcttgcatcatggatgattgtcctttattgcctgatattcaatgtctttttttttttttgagacagggtctcactctgtcacctaggctggagtgcagtgacctgttcatagctaattgcagcctggacctcctgggctcaagcagtcctctcgcctctcctgagtagctgggactataggcatgagccaccacacccacctaattttttatctttttgtagagatagagtctcactatgttgctcaggctggtcttgaactcctggcctcaagggatcttcccacctcagcctcccaaagtgctgagattacaggcatgagccaccgcatctatccttcaatgtctttaaaacaattttttccataaatgttgtccaatattttcaagtagaagagaaaatttagtccctgttattccatcttggctggaagcaaaagcagaagtctagatctatgtttttaatagttgagttttattctattatatgcatatatcataattaatttaattaccttttacagatattttgaattctttttcaaatgtttaccctactgtggcagatttcctggtgtgtttgtctttgcatctgtgtgcaaggaaacgtattagacaaattctgagaattactggatcaaatagttcagcggtccccaaactttttggcaccagaggctggtttcgtggaagacaattttttcacagatgggggcaggtggtaacgcttttggaatgaaactgttccacctctgatcatcaggcattagatggagcacacaacctagatgcctctcatgcacagttctcaatagggtttgtgctcctatgagactctaatgccgccactgatctgacaggaggtggagctcaggtgataatgctcatgcacctgccactcatctcctgctgtacagcctcattcctaacaggccacggacctgtaccagtccatggccaggggattggggacccctgaaatagttaatccagtgcatactgactacatacatttaaaacattggtagatgttgttgaagtgcctttccgaaagatcaaactcagggctttttatatgtgttttgttaagccagacctactgcttgtggaacttggatttattcccattaacattaatttgaggggccgggcatggtggctcacacctgtaatcccagcactttgggaggccgaggtagacggatcacgaggtcaggagatcgagatcatcctggctaacacggtgaaacgctgtctctaataaaaatacagaaaaattagccgggcatggtggcgggcgcctgtagtcccagctacttgggaggctgaggcaggagaatggtgtgaacttgggaggtggagcttgcagtgagccgagatcaagccactacactccagcctaggtgacagagcaatactccatctcaaaaacaaaaaaacaaaaacaaaacaaaacaaacaaaagacattaatttgaagagttgattctcatactagagattttttttttctttttttttttgagatagagtcttgccctgtcacccaggctggagtgcagtggcacgatcttggctccctgcaacctctgcctcccaggttcaagcaattctcttgcctcagcctctggagtagctgggattacaggcatgcaccaccatgcccagctaattttttgtatctttagtagagatggggtttcaccatgttggccaggctggtctcgaactcctgacctcttgatctgcccgcctcggcctcccaaagtgctgggattataggcatgagccaccacacccggctggagatctcttttttaatcaatgttcttgacgtataatttttatataatagagtgcacatattttatgtgtatagttaaatgacaaattagaaaaaaaattctttttgagacaaggtttcactttgtcacccagtctggagtgcagtggcatgaacatggctcaatacaaccttgacctcccagactcaagtaatcctaccactttagcctcctgagtagctgggactacagtcacatgccaccacaccctgctaatttttgtatgttttgtagagacgggggtttgccatgttgcccagactggtctcgaactcctgagctcaagcgatcctcctgccttggccttccaaagcgtgggattacagtggcgtgagccactgcgcctggccatagttccatgacaaatttatacctctacaatcaagttatagaacatttccatcaccccacaaagttcccttgtgccgcctcccagtcaatctctacccctcacccttgccctaggcaaccactgatttgttttctatcattataggttagatttgtcttcctatggtttcatataaatgagatcatacaggccaggcatggtggctcatgcctgtaatcctagcactctgggaggccgaggcaggtggctcatgaggtcaggagattgagacaatcctgactaacatggtgaaaccctgtctctactaaaaatacagaaaattagctgggcgtggtggtgggcgcctgtagtcccagctactcaggaggctgagacaggagaatggcatgaacctgggaggtggagcttgcagtgagcagagatcgcaccactgcacttcagcctgggcgacagagtgagaatcctctcaaaaataaataaataaataaataaataaataagatcatacagtatggactcttgtttctggcttcttttacttagcatgctgagtagtttgctcctttttatttctgaattatatttccttcgagtttttttaaatttcattttaagagatgaggtctttctatgttgcccaggctgaagttgagctcctaggctcaagcaatcctcctacctcagcctcctgagtagctaggactcaggtgtgcaccactgcaactggctcttggtgatctttttaaataactctcatggagggcctattatatgtcggtgctgtgctaggcatatcacatactttatctgcaattcttttttttgaggcaaagtcttactgttgcccagactgcacacagtgttgtaaacacagctcactacagcctcaacttcctgggctcatgcaatccttccatctcagtgtccccagttgctagagctacaggtgtgcaccagcatgcctggctaattctttaatttattgtagagatgaggtcttgccatgttgcctaggctggtcttgaactcctgggctcaagtgatcctctactttgatctcccaaagtgctgggattacaaatgtgaactaccatgcacagcctgtaattcttacaatagttctatgagagggctctgatgcttatatgacttgtccaaagttccatgaccagtcatccatttatctcttattgctgactctgccccaatttgaaagcccagtttgaaggccgggataaatatggtctgttaatggaatgaatccaagagacctgagttcaaatccaagctttaacctttttctgggtgacttgagctctctgctgttcatcttatctcttaaagtgtgttaatcacccttctccagatgtaatagatgtaaaggctctagcgcagggcctgccacccagggacattacatggaggccacagtgttttatctttcttttttttttaaaaaatttccccatgtgctagaccatccaggcaggttcctgtgataagcttcaactactaccaccataaccatcatatatgcaaagatccataagtatcttttcctgtgctttctctaacagaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccagtaagctcagccctgggcagatagacgggtccagattgtggttgcaaagggagataatacttatatggcagaatgtcagggatgcggataaggggcaaaggtggaggacacaggtcaatcccaaaggattgtgcatgaggcaacctagagatgtcctgggtctgagagccaggacctgcattctccacctgtaactcacaaggctacgtcaggcattcagccacttcttttctcagggcctcagtaacccatttaaggaagaaggggctggacatatcttctggctctgacattctgtcagtctgtgtgtttctgggcccttttgattctgagctgcttcagaaaattctgtccatctaaggaaggcagttacagcatagtagataagagcctgtgtttggaattaagcctggcttggccacttattttagctcttattttagaggtcaagggacttgacctctctaagctgtatttcttggtagataatagcatctaactcttggggttgttgcaagccagcaattaaatgagataatgataattatagttaacacttacagagtattttttgtagctgggcatagtggcacatacctgtaatcctagctactcaggaggctgacacaggagggtcgcttgagcctaggaagttgaggctgcatgcagtgagctgtgatcatgtcactgtaccccagcctgggcaacagagcaagatcttgtctctctctttttttttttttttgagatggagtcttgcactgttgcccaggctggagtgcagtggcgcgatctctgctcactgtaagctccgcctcccgggttcacgccattttcctgcctcagcctcccgagtagctgggactacaggcacctgccactgtgtctggctaatttttttgtatttttagtagagacgaggtttcaccgtattagccaggatggtctcggtctcctgacctcgtgatccgcccacctcggcctcccaaagtgctgggattacaggcatgagccaccacgcccaaccgaccctatctcttaaaaaaagaagaaaaagaaaaagaaaaaggaaacaggctgggcatggtggcttatgcctgtaatcccaacactttgggcggctgaagcgggcggattgcctgaggtcaggagttcgtgaccagcctggccaacatggtgaaaccccgtctctactaaaaatacaaaaattagctgggtgtggtggcggatgcctgtagttccagctacttgggaggctgaggcacaagaatcgcttgaacccaagaggcggaggttgcagtgagctgagatcacgccactgtacttcagcctgtgcaacagagcgagactgcatctcaaaaacaaaacaaaaccccttttctgtgcccagtactgaattatctaatttaatctctgtaacaactctacgagtactattataatcattcccatttttcaggtgagaaaaccaaggtacggggagagattgagttgtttgttccaggttgcgcaggtagaaagtggcagagccaggattcaaacctgagcagctcagtgttgttatcggtatgattgtcacgactggtatgaggcagatgcacattggggtgctgtgcttttgttttttctggagagactgaagagcagaagaggagactcagtggggaccagcctagaatcagctcattgctgggcccagagcagcacagccccctccccctgctacttttgaaattgaagtgtcataatgagactaacaatggcaccagtgtcacaatccctgcattcctacaagggccacttcacgtgagtcctttgcctgttaacatttccaagctcctggcctccataacgagcaccctgtgacttttgagacgttatggataatccttctgaagaatctaggttgcagtgagccaagattgtgccactgcactccagcctgggcgacaagagcaaaactctgtctcaaaaaaaaaaaaaaaaaagaaaagaaaagaaattccttcctcttggctgggcgcagtggcttacgcctataatcccagcactctgggaggccaaagcgggtggatcacttgaggccaggagtttgagaccagcctgggcaacattgtgaaaccctgtctctgctaaaaattagctgggcatggtggtgggtgcctgtagtccctgctacttgggaggctgaggcatgagtatcacttgaactccagaagtggaggttgcagtgagcagagatcccatcagtgcactcgagcctggcgacagagtgagactccgtctcaaagaaaaaaaagaaaaaaaaaaagaaagaaattccttcctcatgctgagcatgagagggccagcctggacttcccacccattaggcctggcttggctgcatgggatcatcagcccctgcctccaggagaacagccctcaggtgtttaaggggagggcctgtatcaccttcctctcccaagtctcctctttcgcaccctccaattcctgacaatgggagtcagggcttgattttgagttttctcgccttctgggaagttgtgaattccccagggaggggagccctccatgtgcagaagagtgagggctgattagccagggcctcaggagcagactgtgttacagatgagctctctaacaagctgtcacatttcagatccaggcctgctcagtcgatcaaatgtgccatgatcaatatcaagcctggtgagctccccaaggaggctgcagtgggggcctacgtgaaggtgcacactgtggagcagggagaaattttggtgagtgtgccaagagctctgttcaccatggagtacgtaacatgaatgggctggaatgttaagtaatgacagtaaaggtttaaaaacacttccctccatatttgatattaaggaattatgttgatttgtaaagatgtgataagaataggccgggcgcggtggctcacacctgtaatcccagcactatgagaggccgaggtgggcagatcacaaggtcaggagtttgagaccagcctgaccaacatggtgaaaccctgtctctactaaaaatacaaaaattagctgggcatggtggtgtacgcctgtaatcccagctgaatccaggaacaaggcaaagatgttccctcttaccactcctattcaacattgtattgaaagtcctagctagtccattcaagaaaaggaaataaaaggtatacagattgggaagtaagaaataaaactatctttgtttgcagataacattattgtctatgtagataattccaaacaatttttttaaaaagaaaaacctcctgaaactaatgagattatagcaaggtcacaggatacaaaattaatatagagagtccattgctttccttataccagcaatgaacaattgaaatttgacatttaaaaacacaataccagctgggcacagtagccccagcactttgggaggctgaagcgggcgaatcacttgaggtcaggagttcgagaccagtctggccaacatggtgaaattccatctctgctaaaaatacaaaaattagctggggccaggcatggtggctcacgcctgtaatcccagcactttgggagcctgaggcaggttggatcacttgaggtcaggagttcaagaccagactggccaacatggtgaaaccccatctctactaataatacaaaaattagccaggcatggtggcacacacctgtaatcccagctactcgggaggctgaggcaagagaatcacttgaacctgggaggcggaggttgcagtgagctgagatagtgacgttgcactaaagcctgggggacaagagtgaaactccgtctccaaaaaaaaaaaccaaaacccaaaccaaaaagccaggtatggtggcaggcacctgaaatcccagctatttgggaggctgaggcacaagaattgcttgaactcaggaggcagaggttgaagtgagccgagattgtgccactgcactcctcttgggtgacaagagcgaaactccatctcaaaaaaaaaaaaattaataacaaatacataaattacctaatatttttatagaatctaatttctaaaaaattcaatttctaggccaggcatcgtggctcacgcctgtaatcccaacactttgggaggccacctgaggttgggagttcgagaccagcctgaccaacatggagaaaccctgtctctactaaaaatgcaaaattagccaggcatggtggacacctgtaatcccagctactcgggaggctgtgtcaggagaattgcttgaacctaggaggcggaggttgcagtgagctgagatcgcgccattgcactccagcctgggcaacaagagtgaaaatccgtctcaaaaaaaaaaaaaaaaaagaattcaatttctaagaaatccattatgaaaaggctaaatattgcatgattccaattctatgacattctggaaaagaaaaacactatagagatagtaaaattatcagtggttgcaagaggtttggagttcaggagatgggatgaataggtgaagcacaggggacttttagggcagtaaaattattctctatggtactgtaatggtggatacaaaagcatttgtcaaaacctatttaattttacagcacaaagagtgaatcttaatgtatgcaatttgttaaaaaagaaaaaaaatcagccaggcatagtggctcacgcctgtaatcccagcactttgggagtacgaggcaggtggatcacgagatcaggagattgagaccatcctggctaacatgatgaaaccgcgtctctactaaaaatacaaaaaattagccaggtgtggtggtgggtgcctttagttccagctactcgggaggctgaggcagaagagttgcttgaacccgggagttggagcttgcagtgagcagagatcgcgccactgcactccagcctgggcaacagagcgagactccatctcaaaaaaagaaaaaagaaaaaaatcatctaggaggttagtggatctgaggaaggaatacaaactatgacaagataatctaaccattataaatgtatgaaacaatctctgtgaaggagttggggggaaaagatgctgacttaagtaactttggaaatgagtggaactggtaagactaaagcaaaaggaactgtgtctgagcactgtgccctagtgataaagctgtttgtcatgaaggtagggattaacaatacttctactactatacatgtacacagtgttaacactgaaataaatcagttcagtaaatggatggcagagggtgggagccaggtttttcacaatttaagcaggaatatatagaaagcagggggagcctagaatactccatgtagtaatggattagagttgaaaacatcagtagtcactgaaatttaactcaatatatacttacagataattatgtatagaaatatgtataggtaggccaggtgtggtggctcacgcctgtaatcccagcactttgggaggccgaggagggcggatcacgaggtcaggagatcgagaccatcctggctaacacagtgaaaccccgtctctactaaaagtacaaaaaaaattagccgggcgtggtggcaggcacctgtaatcccagctactcaggaggctgaggcaggagaatggcgggaacccgggaggcagagcttgcagtgagctgagattgtgccactgcactccagcctaggtgacagagcaagactccatctcaaaaaaaaaaaaaggaaatatgtataggtatgggtggaaacatacaactgttttgctctgtcagataatagggcctaaaagaaatgttacccttccagcaatgagcacacttaacacttggatcttggttggtttcttttctttctttctttcttttttttttttttgacagagtctttctctgtcacccaggctggagtgcagtggcgccatctcggctcactgtgacctctgcctcctgggttcaagtgattctcctgcctctgcctcctgagtagctggcattacaggcacacgccgccatgcctgactaactttttgtatttttagtagagacggggtttcaccatgttggccaggctggtctggaactcctgacctcatggtccacccacctcggcctaccaaagtgctgggattacaggcatgagccactggacctggcctcttttattttttttttaagagacagggtcttgctctgtcactcaggctggagtgcagtggcaagtgatcatgggtcactgcagccttgaactcctgggcccaaccaatcctctcacctcagtattctgaatagctgagactacaggtgtgtgctgccatgcccaactaattttttttatttttcgttagagacagggtctcactatgttgcccaggctggtctggaactcctggcctcaagcaatactcccaccttggcctcccaaagggctgggattacaggcgtgaaccatcgtgcctggcctccatactgtttttcatgatggctgtactaatttatattcccaccaatagtgtgtgagggttcccttttttgcaaatctttgccaacatttgtcatattttgtctttttgatagtaaccattttaacaggtatgactcaacatctcattggattttcaatttgtatttccatgatgatcaatgatgttgagcatttttttcatatacctgttggtcatttgtatgtcttcctttgagaaatgtctattcagagtttttgcccacttcttaaccaggctgtttgatttcttgagactgtgttgtttaagttcattatacattttagttattatccccttatcagatgtacggcttgcaaatattttctaccattctttaggttgtctttttactttgttggttgtttcctttgctatgcaggagctttttagtttgatgcaatctcatttgtctatttttgcttttgttgcctgtgtttttggggtcataccccaaaaaaaaccattgcccaggccaatgtcaagaaaccagatcatgatttctaatacagtttcccaataaaaggaacaagggctctttggaagaatggttgaatctaggactagggcaggaaatacacaggatgagtctagaacatattgtaaatgccagaaagtaaggaagagctaggggagggggcaggaactgctttaatatgggagcatgtccaagggacatatgggggccacctaaaagatctcccaatggtcaaagctgaaacaatttgaacaacaaaataaagcagtgttggattataaccaaaagtacaaaataaacattcatgagtgcatattgatataaatgaattaataatgaattaataaatggaggagaagagacaaatctccctgcagaataaatttcaagcaatttatgtagatactctgtcttaaaggagagagtgcctaactctctacttaaatgtgggccatgcataggacttccttccaaagagtacagtatggcaaggggggaatgaagtaactttacaatggaaaaaatctgaaaaacacagccagatcatcaaggccaacatcaacagtaaaacatcatgttaatagtattgtcccttgacaggatgtgatgaaaatgtcatttaacctctgtggccatcctctcaatatcttataactcctgtctaatcatgagacgtgattagaggaaaatcatgagacaaattttaactgtggcatcccacaaaatactcaatgagtaccctcaaaactgccaaggtcatcaaaaatggcctgagaaaatgccacagccaagaggagcctaaagagccctattattaaatgtaatgttgtatcctggataagatagtggaatagaaaaagggcattaggtgaaacaggaaatctaagcaactcattgactttagctaacagtaatgtagcagtagaggttcactaattgtaacaaagacataccaatgtaagatgtgggaaactggatgtggggtatatggggactctctgtactatcttctcaattttcctgtaaatctaaaactgttttagaaaataagaccaccaggccgggcacagtggttcatgcctgtaatcccagcactttgggaggctgaggcaggtggatcacctgaggttgggagtttgagaccagcctggccaacatggtgaaaccctgtctctactaaaaatacagaattagccaggtgtggtggcacacacctgtaaccccaggtactcgggaagctgaggcaggagaatcgcttgaacccaggaggtggaggttgcagtgagccaggattgcaccactgcactccagcctgtgtgacagagtaagactctgtctcaaaaaaaaaaaaaaaaaggaatccaaggctgggcatggtggctcatacctgctgaagcccaggagttcaagaccagcttgggcaacaaagcgaaatcctgtctctacaaaaaattaaaaagttagctgggcatggtgacatttgcctatgatcccagctacttgggagggtggggtgggaggattgcttgaccctgtgaagtcgaggctgcagtgagccatgattgtgttactgtacttcaatctgaacaatagaatgagagcctgtctcaaaaaaaaaaaaaaaaaaatgcagttgtgggagcgagggcagtatggatgaccacgcttggctatgagctgatcactatggaagctgggtggcaggtgccagagctgaatgagaggaggaggagcagtgtgcgggtgcagaggtagggcaggagaagggatttcaggaggagcaatgggccttcggcctccctgtgcctgcagagggctgtctcctgaagcctcatgtgtggttattcagcatctgggaaactgttccctcaccaagccctctcctctgttcctctgtcactatctccaaggttgtccttatgccattctccccctgtgttatggtggactgtgcatgctccttccctccactcacaccagcctgtatgtcctcagggctgggaaggtcagtccagtactgtctgggaggtccagtccctagcacagccctctgtcaatgctgattattttttagctcttagaaatttcttccttttgtttagtaaaacattgcctcctacaactttaaactagctcctctcctctccctgccctgttccccaaaacagaagaaatccacttccttagcatgtgatgcccttaggtatttaaagaatgctgttttgtttttcattcaacatttatgtagccaggcacagtgccagtgttccgttaattattttcatattcacgcagagtggcctccattccttcggtcattcttcaaggggcgtaatttccagccttccagcctattgctcctcctggaaagcccttctgcctgccccacctctgcgcccacacaccgctcctcctgccactcagctctgtcacctgcctcccagcctccatagtgatcagctcacagccaagcgtggtcacccacactccccctgcccccactactggattcattgttttagtggtcttattttttagaacagtttttagatttacagaaaaattgagaagatagtacagagagtccccatatgccccacgcccagtttcccctgttattaacatcttacatttatacgtctttgttagagttagtgaaggtggtgtctgcttcacttcaatttattaatgtttcagagtaaggtgctcagagatgaacacagggcactaagggacagggaggcctgggcaggatggaggcacgaggatggaaaaggccttgctcagtttggtaggcagtgacaggaggggaggctgtgtcaggaacaggaacaacagggtctgttttgtccaggccctgcaatgctggaacagggagtaaggccttgatttcctagaagtcctggaaggctttgggtggggacttagcacaaggacctggctgctgcttcccacatagggccagcacatagaaagccttcaacaaatatttgttaacatgacccctttgaagaaaatgtctgcggatgccttcgtgaggtgcctgtggtaggactctgagctccctgtgttgaggccctggcttcagctgtaggagaatgagagtggtaactgcttgactgaacccgccccctggaaggtgggtcacatcgtcctcacccttgggagtagcagtgtggagctgggtcagccctgggagcagcagagggtggggcctagggtggagggacccaggttttgagccaggagatataggaagtccaacttctccaaggaacaggcaggctgaggcctctgaggtggtcaagactgggcaggccagagccatgggcagcgcagaagagaggtggcaagcagcatttcttattttcattctgcttctaatagttagctgtgtggccacgggcaaatcactttccctttctgaatctatgtcatgggaaaatgaggagattcatctgggtgagctgccacctctaaagttgtgtggctccatttgggtcactcattcagcagatattccttgagcacctaccatgctccaagcatggaacaaagtgccattgtggctgagtagactgacgtaattcctgcccttatggggcttatgatctagtcaggacagacaacaaacagataactagtaaatacatagaaagttacaaattgctgttaggaatggaatgaaaagcagggtgggtggggaggttcttaaatggggtagctaagggaagtctgctgtgaggaggtgatgtttaagctgagacctgaatgatgaaaataataagctatgggactgggcacagtggctcacacttgtaatcccagcactttgggaggccaaggaaggaggatggctgaggccaggatttcgagaccagcctgggcaacatgatgaaaccccgtctctaccaaaaacaaaaattagccgggtgtggtggtgcacacctgtagtcccagctactcgggaggctgaggcaggaggatcccttgagcccaggaggctgagattgtagtgagctgaaatcatgcaactgcactccagcctagggacagagtgagaccttgtctcaaaaaaagaaaaaaaaaaaaaaaaaaaaaaagaataagctatggaacgacctggcagaaaagtgttcaagacagacaagcagcaagttcaaggttcaaggcaggagggaggaggcgtgttggggggattggaagggagggcagggtggctggaacagactaagcaaggcagcagtgacatgaggctgagatggagggcttggaagggtgagacagcccaggccttaggcggcatgagatttatttgatcccaggtgctttgggatgctgtttgaagcatctagccagagaagcaactgactccagctgtgtgcatgcagcaagtgggttggaggtggctgagagagcaagcaggacagcagtgctcctgagtggatccctggttcaaggttgggctctgccactttatgtctcattaccttgggcaagctacttaacctgtttgtgcctcagtttcctcattgtagttgctgaaagcacagactctgaagacagaccacctgattcaaagcctaggtttattgctttcctgatgtgtgatgttagacaatttttcttttctttttcttttttttttcttgagacggagtctcgctgtgtcgcccaggctggagtgcagtggcatgatctttgcacactgcaagctccgcctcccgagtttatgccattctcctgcctcagcctcccaagtagctgggactacaagcacccgcaccacgcccggctaattttctgtatttttaatagagatggggtttcaccatgttagccaggatggtctcgatctcctgacctcgtgatctgcccacctcggcctcccaaagtgctgggattacaggcatgagccactgcgcccggccgatgttggacaattttcttaacctcagcatcctcacctgtaacatgagaataagaataggagtcagctcactggattgtggtgagggttaaatgggttatagatgcaaaaactacaaaagggcctggaatttagtgagtgctcaataaatgtttgttggtgctattattaccatttcatcatcattgctattgtaattataagatgattgaccgtggataggtaaatttcctttcctgaacctcattttccacatctgaggataacccccacatgctaggatggttgtaaggtgtaaattcatatatatatgtttcctctccagagtaggagctggctaaagagcagccattctggtttctatgcaagtcctggcattgactaggagggcctttgttcccactgtactcaacatgagagacacacgaggtgcttcatgtcccccagagaactctcacatgtgccatctcgtgtagaccctcagcagcttcagaggaaaggtggcatagctccaccccagtcttgccaaagagagacaaagccagggctcagagcacccaaaaatttgtacgtggtcatatttcaaggtctagaacccaaatggtggaggtggggagggtgttccagatcccacttcacatctcctttcaaattcagaatccttcggagacatgtcgatagatattctcacctgcatttcacaggcgagcaatggcccaggaggtactgtgtgccccaaatcacataagtacaattttaaaatatggaatcaatctaagtgtccgttaacagatgaatggataaggaaaatgtgggacatatacacaatggaatatcattcagccataaaaaggaatgagatcctgtcatttgcagcagcgtggatggcactggaggctgttatgttaagtggaataagccaagcacagaaagacaaatattgtatgttctcactcatatgtgggacctaaaaactggatctcatgaagatagggagtagattggtggttaccagaggctgggatggggaggaagagagggaacgaaaagaaagaatatgcatgtatttatttccagtgaactgtatgcttaaaaatggtaaagatggtaaattagatgtgtatattgtacttcaacaacagcaacttggatccaggattagtcccaaccccatgtgtcctccacagagtgggcctcttggtttgtggccctttttcttcttgagccctatacagctggcattggtggctctggggccactaaccgttcctgcccctgcccctccttgcctgagccttgattaacagctgagaggctgaagactgagcactggattgggagttcagcaacaaggattctagtcctggctctgcctgtcccaggtgtctccttaaaaagcggattgcacccttcatcacggaagcaagtatgcctgtggacttccatctcccttccagatagaacaaagtaggaattcaagccaaggaacaggagggcagctggagagaggaggacctgtggccaccgaagtctgtgagggatggaggagaaacagaggcctgcaggaaagtgtggggtgggtggctgcaaagataaggtccagaagaggactggctgtttgattttttattttacttttttttttttgagtcacagtttcactctgtcacccaggctggagtgcagtggcacaatcttggctcaccacaacctctacctctctgattgaaatgattcccctgcctcagcctcccaagtagctgggattacaggcaccggccaccatcaccatgcccggctaattcttttttttttcttttttttttttttttttttttgagatggagtctcgctctgtcgtcaggctggagtgcagtggcgcaattttggctcattgcaacctctgcctcccaggttcaagcaattctcctgccttagcctcccaagtagccggaactacaggcacgtgccaccatgcctggctaattttttgtatttttagtagagacgggttttcaccgtgttcgtcaggatggtcttgatctcctgatctcgtgatccacccgcctcagcctcccaaagttctaggattacaggcatgagccactgcgcccagccctaatttttgtattattagtagaggtggggtttcaccatgttggccaggctagtctcaaactcctgacctcaggtgatcagcctgcctcagcctcccaaagtgctgggattacaggtgtgagccaccacacctggcctattttacttttttgggatagtctctcgctctgttgcccaggctggagtgcagtggcgcgatcttggctcactgcaacctctacctcctgggctcaagaaatcctcccacctcagcctgggactacaggcatgcactatcacatctggctaacttttataatttgtgtagatatgtggtttcaccatgttgcccaggctggtctcaaactcctgggctcaagtgatccacccgcctgggcctcccaaagtgctgggattacaggtgtgagccactgcacctggtgcctagctgtttgatttttgttgtaagtcctaaggaagagaaaagagatttgctcgacaaaaacaaaaacaaaaacaaaacaaaacaaaaagctgtaattggacattggggaaaacttgagagcaatagtggcagtgagattgctggagtgggacagtgggtaatctgatttaggtgctcttctaattccacggttagaggaattccatatgatgtagcaaaaggggcccaggatttctcctgcctgtcatttgctcagtgatcccagataaattcacctcctgtttgaggccttctttttcccatctagaaaatctgtgggtaggctgggcacggtggctcacgcctgtaatcccagcactttgggagaccgaggcgggtagatcacctgaggtcaggagttcgagaccagcctgaccaacatggagaaaccccatctctactcaaaatacaaaaggtagcgcatgcctgtaatcccagctactcaggtggctgaggcaggagaatcgtttgaacctgggaggcagaggttgcagtgagctgagatttgggccattgcactccagcctgggcaacaacagcgaaactccgtctcaaaaaaaaataaaagaaaaaaaagaatgaaaatctgcgggcagacctggccagtctctgaggtctaactttctgtgacttctcccgagggtcttcaccaggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccaggtcagtactggaaatgtgcgtaagtcccatcaggtgaaatgaacaatttttcacctgttattttagtaaaagaaggaaaaatataatacctgttgctgacaagggtgaaatgaaactgggagttgttggtacactctagataggctcaatccttttgataataattttagcattacatttcaagtgctataaaactgtcccaacactttgagacagagattcatctgtgaatttatagagccgaaatatggagaaagccctgcattaagatgttcattgcagggttgggtgcgatggctcacgcctataatcccagcactttgggaagctgaggcaggcagatcacttgaggtcaggagtttgagaccaacctggccaacatagtaaaaccccatctctactaaaaacccaaaattagccaggcgtggtggcacatgcctgtaatcccaactactcaggaggctgaggtaggagaatcgcttgaacccgggagacagaggttgcagtgagctgagatggcatcactgcactccagcctgggtaacagagtgaaactgtgtgttaaaaaataataaggctgagcgtggtggctcactcctgtaatcccagcactttgggaggccaaggcaagtggatcacctgaggtcaggagtttgagaccaggctggccaacatggtgaaaccctgcctctactaaaaatacaaaaattagccaggcatggtagtgggcctctgtaatcccagctactcgggaggctgatacaggagaatcacttgaacctgggaggcagagtttgaagtgagccaaaattacaccattgcactccagcctgggtggcagagcaagattccatctcaaaataataataataataggctggacgtggtggctcatgcctgtaatcccagcactttgggaggccgaggcaggtggattacctgaggtcaggagtttaagaccagctggccaacatggtgaaaccctgtctctagtaaacatagtctactaaacacaccaccgggtgtggtggcgggcacctttactcccagctactcaggaggctgaggcaggagagtcacttgaacccaggaggtgaaggttgcagtaagccaaggttgcacctttgcactccagcctgggcaacaagggcgaaatctgtctcaaacaaaaataataataataaaaaataaataagatgttcatagcagccatattcataatagaaaaacaatgacaacaacattgatgtgtgccacactaaggggatagtttataaaattgtggtatattctcttgatagaacataattgttttatttaaaaaatggtaagcttaatggctctgtaacagcagggtaaaatgggtgatataatgatactggaaaagggtggtacagaattgtacatgtgctatgactatgcctttataaaacacttacccgagagaaacctagaaggaaataagcaaaaatgacaatgcctatggtaagagtcgttttctctgggaggtgagactaaaggggactttctggttatatattcctctcatgttttattttatttttatttacttatttttttgaggcaggttctcactctgttccccaggctggagtgcagtggcacaatcatggctcactgtagccttgaccttctgggctcaagggatcctcccacctcagtctcctgagtagctggaactataaatgtacactacaatgctcagctaattgaaaatttttttgtagagatgggggtctcattacgttgcccaagctggtcttgaaccagtcctcctgccttggtcttccaaaatgctgagatttacttttataattattaaaaataaatatgtatcttgaaagattagataattttttttttactttttcatagtgtccaaattttctagagtgaatgttaatgcttttataatgggaacaaataacttttttaagtgtaaaaattaatttattgcccagaccagtggtctcaaaactgtttccatctcacactgctattactaaaaagtgttcaagcatgtactccctggtatgtatatgtaatataaataacatctgttaatttgtttttattatatccacatataatattactgtaccaatatatattataaacatataaaaattgatcttttaaaagaaaaagagaaagataaatataaatgaaatcctactattcacatactctagtggatcttgtacatctccctgggtgacatgtctctccaccccggctttgttttgtgtgtgtgtgtgagagatggggtctcactctgtcatccaggctggcatgctgtggctgaatctcaactcactgcaacctctgcctcccgggctcaagtgatcctcccacctcagcctccccagtagctgggacaacaggcaggcgccaccatgcctggctaatttttttgtattttttggtagagacggggttttgccatgttgcccaggctggtctcaaactcctgagctcaaaggatccacccaccttggcctcccaaagtgctgggattgcatgagccaccgcgcctggcctccacccccacttcgggaccaccaagctagactcccgcaagtcttatcacgggttcctccccttcagtctcctgcctgctggattctttctgcacactgtgttcttgttaaaaccctaatctagttgtgttaaactcctgcttgaaacctttcaatggtatctcactgcctataggataaagtccaaactcaatgctacctcaatgacccaccacagtctgacaccccactcaagtcccctccagcatctcctgccacctccaactcactccagcagcccaggcgggttgcctgctagatgctgcacataccttgcctttgccaatgctggcccttttgcctgaaatgctaaccccagtcctgcctccaccctttgtgataaattcctgctcattctctaagattcatcttctgcagcaaacctcctcagactaaccccagtttgggataagtaccccctttctgcacactcataatattctctacacagctctgtcattgaccgtatcgtgttgtcatacagttacctgtttgcacagctctttcccttccacctgattaagtgcttcaggaaggcaaggctgtgctttatccgcctttggtctctagcacctgtacagtgcccagcatgcagaaggtgcttaataaatgttgactaaatgtgatgggccatactcattgcagaagattgaaaaacactgaacagcaaaaaaagacaaaacccaaatcatttgcagtcttccagcaatcccagttagcatcttctgtatttccttttagtgttttattcacttcgtgaatatgtgccaaatatgcctttattgtcatactctgttttcataatggagctcatacttcttacacattttctttacttgcggtgatattgtggtcagatacggttttggcagcaggtgtgggaagcgagtgattccaatggtagagaaagggggtatgaaggcagacagagctgcaggtgattccagccctggccaataagcacacaaaaggctctgacgtgagatcttcatgaccttgagcagtgtgaggtcttcatgaccttctctaggcttttgactccaatcagcaaaacaagaaaattagagtagatcagtattttttaaagtatgaacatattccacaggagggttacaggatgattttaggtggctcacagattgacgtttttagttttaacatttatgtatttatttatgtgaattagaaaaagcagcatgactaacttactaactgtgtgatctgacagatcttgttgcttaagacaaagttaaagtaaatatttaagtaaaaggaactgaacagattgaaggaaaatcatttgtaatttttttttttttttttagacagagtcttgctttgtcacccaggctggagtgcagtggtgtgatcttggctcactgcaaactctgcctcctggcttcaagtgattcttctgcctcagcctcccaagtagatgggattacaggcgccgccaccacacctgactacttttagtagagatggggtttcaccatgttggccaggctggtctcgaactcccaacctgaggtgatccgcccacctcggcctcccaaagtgctgggattacaggtgtgagccaccgtgcccagcccggaaaatcattaataaatttaaagagcagatgatatgtagataaggccaacactggggcagtcttgtgagaaaaacaagctgaaaaatactggcggttccttctggttcaaggatgccacacttctctgattcctgggtattaccaatataggaaatggccatgtagacctgccactcaaaaaagggtttaaggagccttagctccttgcatattgcctggcacatgatggggatcagttaatatctgttgaatggaaattcataaaaggtttacatagagttgagtgggggcagatggaacattcagcatccgccctgctcagtcagcatttgcggccctcatctagaatgctgacccacagaattctgtcttattcattaatcgttgaactcatgcctttctagactgctaaaacaggcagaaaacatatccattatctagctcaaatccctcacgttttaaccgaagactctgagatcctgaagatcacagagccggtggcagaggtacctgtcctgtgaatagcgcaggctggttatcctgaaaatcacccctacagagcacagggcggcccatgtggggtagaatgcatggctgcatccacaagaaagtcaggaaatccccaaggccaaagtgaagaggatcacccaaaacagacagacagtatgaactaatgctggggattgcccaggagggcttaagggcgtcacgggctggttttttttgggacggagtctcactctgtcgcccaggctagagtgcagtctcgtgatctcaggtcactgcaatgtccccccactgggttcaagtgattcttgtggctcagcctcctgagtagctgggattacaggcgtgtgccaccacacctggctaatttttgtatttttagtagagacagggtttcaccatcttggccaggctagtctcaaactcctgatctgaagtcatccacccgcctggtctcctaaagtgctgggattacaggcatgagccaccgcacccagccatgggttgattttttaaagcctgaaaggacagatgcagctttcagttcaagtgagacaggggattggaactgagacccctgtgtgaagctgaggctaccctgttcagtgaaaaagtagactagaaatcaatgtgaccatcagcatcaggaagtgacatggagtcttgtctgtcctagcttagaatctaggttaaaaaaaaattatcccctaagaattagtcatcacatgctttccccctcctaggttttggtgaatcccttagcctcaccccaatttctatgtttctgaaatggagtggttgtgaaaattaaatgagttcacaaatgtaaagtgcttgacacatggtaagttctaagtctgagtgagatgttgttgttatttattatgtaagaaattgagagttaatggaactttttaagtgaggactacccagtagtgtgctcatggatgtttaacaaccagctctccaagatgccggaggaggaccctggcttgcagtgtttgctgatttccatagtgtaaatactcccaccatggccagtttcaaactaccaacctgctgccacaagcatggagttgagaagaggtgcacacggtcagctttcatgagcgggtggcagctggctttgtcatattgctgatgctacaggactagcttgtagccatgctgacctctgagttttttcttaagccaatctctatggatcaaagttgactttatctttgtcgatataatctggctggaagaatgaatgttctgacttgttaatgatgtattcagcttgtctgcttaggtaagagagtacaggtgagttagttgaagctttataccaccttgccttgctgtggtctcaggaggcctcagtccttcttccaccttcctcagccgcacttactatgaggtgagggggagggcagagccagaccaccatggccagtccaaggcagccaccagtctacctcctgtctctacagacctgcctgtgctggacatctcacgtaaaccgaatcatgtaatatgtatataccacactttatccatttatcaatataaaatgattaaggagctattttactttctaagttctgtgttctaagtctgtgaaatctggtgtgtattttacactcacagcacatctctatttcagactggctgcatttcaggtactcagtagctacaggtggcccattgctactacatgagacagcacaggcctaagggaagaaaactgtggaaagggaaagggtgcagaaggagagtctgggagggtcagagaagcagaatgaagcgccacatgcttagggaggggagagtggcaggaggcaaggctggaggggcgggactggcatgagaacctcggcttctgtgcctgccctttagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattgggcgctgtgctttctgaatgaccaccatgggagctgtgggacttggaggaagggggcctggagggctgagctgtgggtccacagaggtgtttgggggacagcaatgggggcacagtctcccttgatgcttgagggctgggctgagtgaatggatggtcagaggctgtgtgtggacgggttaatcattgggcataggttcagggtaggagggtcttgtctgataagctggatgtgggggaggctcaaatcaaagtggtcaagactagggttgcaaatgccttccaaggccacacaggtcatctaaaggagggcagcagaagggctgggaaggcaacggggaatggtggagatgctggggcccactgtgtaagttccccatccagatggggcagctgccccttagcccagtcagttgctgccctgtcagaaaataattcgggcctcatatcgtcagtctgtagattcttcaagagaatcaagaaattcaatattttagatgattcctaccagtttttaaacatgagcaactaattcagattgttttcaaatagtgtcaaacaaaacacacatgggcctgcaggtggtgggctgggtccctgtcagagagtggaagtgaggctgcgactgattgggaggagggtacaggagccagagagacgctgatgggacagcatgacaggagcaggcatcaggtccaggatgaggagtgagtagctgtgatagaggaggtggagacaaggaggctgcagagtctgaacgaaagagggctcctcactctctctgctgggtctttaatctggagctgcccaacactgatctgggcctacaactcagggttcctgtctccagcagcctcagcaccacagaccaagctccagacacctctttcccttcgagaaccccataggttagcctgagagcactgaggagcctggcggaggccatggcggcacaggagcctgcccgcttccaagtcccccaccctgtccctggcaaggcatagactctgaggaatgcctgggcgttgagctgggcaccaggagctctggcagtcccaggtgtgcttgtgtctcactggaccctcttgagcactttgattcccttatctgtacctcagtttccccagtggtgaaatgagcaagttggacaagatcaatggctttcatgaatgggggtgatctagtttgaaaagcatattcaacattatagttttgtttgttgaatttattttttattttgagacagggtcttgctctgttgcccaggctgcagtgcagtggcacgatcatagctcactgcagcctcgaactcttgggctcaagcaatcctcctgccttagcctccaaagtagctgggagtacaggtatgcaccatcacgtagggctaattaaaaatttttttttgtagggacagggtcttactgaattgctcaggctggtctcaaactcctggcctaaagtgatcctctcaccttggcctcccaaagtgctgagatttcaggtatgagcctgatacgatttggctgtgtccccacccaaaatcttatcttgaattgtaataatccccatgtgtgaagggcaggaccgggtggagataattgaatcatgggggcagtttccccatactgttctcatgatagtgagtgagttctcacgagatctgatggttttataaggggctttccccttcgctcagctctcattctctctcctgctgccatgtgaagaaggatttgtttgtttccccttctgccacgattctaagtttcctgaggccttcccagccatgcgaaactgtgagtcaattaaacctcttttctttataaactacccagtctcaggtatgtctttattagcaatgtgaggacaaactcatacagagccactacactggaactctgttgaatttaaaagaaagccgttttcatattgcataccagaaaagaagtatgaaatttttctctctgaagggggtgtggacgtaaagggtaaagaagcagtggacttacagatcttcacttccctgatagctccagaatcaaggagtcagggatatctgcagcagtcctggaaaggttgactgtgacctacaaggacaaggggtcactgttttgggaccaagtaagttggggtgtctgaccatatttaggtatccttttgcatttagggctgtggctccaagatgatggtgtgggcttcttattcatccatttgaaatttatttatttatttatttatttttggagagagtcttgctttgtcgcccaggctggagcacagtggtgcaatctcagctcactgcaaccttccggattcaagcgattctcgtgtctcaggctctcaagtagctgggactacaggtgtgtgacatcaggcctggctacagacctggctaattttttgtatttttagtagagatggggttttgctgtgttgcccaggctagtctcaaactcctgagctcaggcaatccacctgtcttggtacttccaaagtgctaggattataggcgtgagccactgtgcccagccttgaaatttatttattgagcactgcagagagagtcaaaggttggataagatgcattttctgttgccttttattttcttggctaggggtcaccaaactccttttaaattttatgtttttaaatttatttttgagacagggtctgtctctgtcacccaggctagaatgcaatggcatgatcatagctcactacagcctcaaactcctgggctcaagcgatcatcctgcttcagcctcttaagtagctgggattacaggtgtgcactaccatgcccgactaattttttttttttttttttttttttttgtagaggcagggccttgctgttctgttcagattagtatcaaactcctggcctcaagtgatcctcctgcctcagcctcccaaaatgccaggattacaggtgtgaaccactatgcccagcccaaactctttatgtaaggggtcacatgttgagcacttattacgtgacagtcaccttgctgagcatctgactgtggagttcagtgacctgcaggctctgccacttaatggctgttgaggattaaaagaggtggtatgtgtataacaaggtggaagatttttttcaccaagatctctgggtcctgcttcctgggaaataagaaaatgcggccaggcacggtggctcacgcctgtaatcccagcactttgggaggccgaggtgggcggatcacgaggtcaggagatcaagaccatcctggctaacatggtgaaaccccgcctctactaaaaatacaaaaaattagctgggcgtggtggcgggcgcctgtagttccagctacttgggaggctgaggcaggagaatggcgtgaacctgggaggtggagcttgcactgatccgagattgcaccactgcactccagcctgggcgatgagtgagactccgtctcaaaaaaaaaaaaaagaaaaagaaaatgcttccagaataacaggcagaacatgttttttagggcagtaatgggtgagaaaatagcctggaagagcaactgaggatgagggtactgagaagggagagagactctgggctgggcttcaggaggtcttgaggggagctgaggaagagcaaagttcctgaagccactatgtgacaaaagaacttgagaaggagaaatgtctgaagaggacttcaaggagtcctctgtgcttttctgtgcattgagaatgtgtccctctttggcatttgtttgagaaaccaagtgaacatttgaatagaattatagaattaggcagtactgctgtctctttgaatccagtaaccaagcagggagtgggcagcaagagatgcttattatattcagcatatggtgtaaagtccctggcatggtaagtgctcagcactcgctaagtgtcattcacgtcttttagaccaaggtcaatttgatcatctagaaactctcttcccccttcagtggaataggaaactgagactttggaagtctgagccctcataatcagtgataaaggccatcactgagtggattggggtaggaggagcctgaatgacttctcgcctaacccccacactcttatctaggtgaaggagctcatgggaacatgaacgggcagcctctcaggggagagtggagacagggcagcaaaccataccaagcactgtgtggggggggtactgtttggaaaaagaatgagtgggacagtgaggggaatgtagggcagggggaggtgggacttgtgtgtgagcctagcttccaggctgtgagctgcagaatgagcgccggttctcaaggttccctttccccagcacacacacacacacatatacatacacacatatatacacacatacacatgcatacacacatatacacatacacatatacacacatacacatatatacacacatatacataaatacacatatacacacacgacacacatacacatacacacatacacatacacacatacatacatacacatgcaataacatgggatcagattcaggcaggatactgggtgtgctggctcacgcctgtaatcctagcactttgggaggctgaggcaggagttcaagaccagcctgggaaacatagtgagaccctgtcactacaaaaaatacaaaaattagccatccatggtggtgcatgcctgtagtccaagctacttaagggagctgaggtgggaggattacttgagccgaagaggtcaaggctgcagtgagccatgatcatgccactgtactccagcctgggtgacagagtgaaactctctctcaaaaaaaagggaaaagaaagaaaaaagaatcaggcagtgggcagtggaagacatgacatgagcatttacctgggagaggagttcactcagaaggagtaaatatgataccccctggcacaagtgtttggaacaaatgacattttcagtgctgcagaggtcctcactgccacctaggcacagatccaagggtcccggaagcccggggtgatctgccatgcctaagaagccagggagagggccccaggctcaggtatggagtacctggtgtgtgccaggcattatgtgaggcactctacagaggccatcacttactctgaaactatttcctggcagctaactggatggcagcatccatttgagagatgaggagcctgaggccccgaaggcaaagctcactcagctaccaggtggtggttccagaaaatccaggaaaaccacagcccagcaccctcctagttaatcagcattgaagtgtgtggacagttacaccaccgttactcatctatcccaaatgagccacctattttcaaaaaaggaagtctgcacacacagccctgaaactgtgctggggagaatataattgccctctggaattattttccatatgtaaataagcatagtcatacttagagaggcaagcccaagctgcttgagccaaaaatatagcccctagtgctaaaagcttccactgtttgggggaaaaataaaaaaaacccacttgaaaaataaacacaggacacattaccagcgtttgttataggtagtgtttaaggtcccaacttggggttggaagaaaggcattgtttaaatcttctattccggtggggcgcggtggctcatgcctgtaatcccagcactttgggaggctgaggtgggcggatcacaaggtcaggagtgcgagaccagcctggccaacatggtgaaaccgcatctctattaaaatataaaaaaaaattagctggtgtggtggcgggcacctgtaaccccagctactcgggggactgaggcaggagaatcgcttgaacccaggaggcagaggttgcagtgagccaagattgcgccactgcaccccagcctgggcgacaagagcaagactccatctcaaaaaaaaaaaaaaaaagaaaagaaaagaaaaaaaaaaagaaaaaagaaaagtcttctattcctttcatataactcctaggaaagtcttaccttccagttaaggggtgaaatgggtcactttgctcatctgcaaggctacatcatagggaaatactttcagggcagtacacgtacaggccattttaccatgatgcctttctactgctgggggatttatggggcttaactgcaagggtgctgagttgctgaatttgtaatcactggtccagagcaaacaatgaggatgagtagcagtttctaggtggctgataagcaggatcaaagcataaacaaaggtttttcatggctgctgccaaactgtgggccttggggacagacactggagggctggggcagtgagaggtagcagagttcagatgtgtgctgtgtgactctccgccaggctccatccctttcctgagcttcatgcctagcatctgtgcaattccaggggtccagcgggtgttctgcacacatagcccccaccccaggggctgagcagggccccacccgcctctcttgttttgtcctcacctatctcgtacttccaaaaccacccacccccaacagaaagtcaggatcaagaaagtggattattgaggctgggcgcagtgcttatgcctgtaatcccagcactttgggaggccgaggtgtgcagatcacctgaggtcgggagttcaaggccagcctgaccaacatggagaaaccctgtctctactaaaaatacaaaaattaaccgggcgtggtggcacatgcctgtaatcccagctactcgggaggctgaggcaggagaatcacttgaacccgggaggtggaggttgtggtgagtcgagattgtgccattgcactacagcctgggcaacaagagccaaactccgtctcaaaaaaaaaaaaaaagaaaaagaaaatggattattgaaccccatggtggcatgtgaaaatgaactgtgggagagataatagtatttatttatttatttgttatgttttcccagatagggtctcactctgtctactctggagtgcagtggtgcaatcacggttcattgcagccttgacctcctgggcttaagggatccttccacttcagtctcctgagtagctgggactacaggtgtgccacaatgcctggctaatttatttttttattatttgtagagacagggtttcaccatgttgcccaggctggtcttgaactcctgggctcaagagatctgcctgcttcagcctcccaaagtgttggaattacaggtgtgagccaccatatctggccgtaattgtatttcttgctgtctgtaattgtactgttacgtaagagactctccttgtacttaggaaatatacactgcagtacttggcagttaagagagataatttcttcaatttactttccaaattatttagaaaattataatatgtacatttagagagagaatggcaaagaaaatatagtcaaataacaactggccagtctgcgtgaagtgtacttaggaattgtttttaaaaaaaatttttttttaacagaggtggggtctcactgttttgctcaggcctgtctcaaactcctgggctcaagtgatcctcctgcctcagcctctttttttttttttttttttttttttttgagacagagtttcactcttgttgccaagactagagtgcagtggcagatcttggctcactgcagcctctgcctcctgggttcaagagcttctcctgcctcagcctcccgagtacctggaattacaggcatatgccaccacgcctggctaattttgtatttttagtagagatggggtttcaccatgttggtcaggctagtcttgaactcctgacctcaggtgatcgaaccacgttggcctcccaaagtgctgggattgcaggtgtgagccaccgtgcccagccactgcctcagcctcttaaagtgctgtaagccgtcgcctggccttaggagttctttgaaccatccttgaaattaaaaacatatgtttaactgtggtaaaatacgaatagcataacatgtatcatcttcatcatttttaagtgtatagttgagtggcatgaagtattctcattgttatgtaactatcaccaccatccatctccagaactcttttcatcttggaaaaatgaaactctgtacccattaaacaatgactccccattactccttcccccctagtccctggcaactacctctctcctttctgtctctatgaatttgagtaccctaggtacctaaagtagtggaatcatacaatatttgtctttctggggctggttcatttacttagcatgctgtcctcaaggttcacctatgttgtagcatgtgtcagaatttcgttcctttttaaggctaaacaatattccattttatgtgtatataccatattttgtttacccattcatctaccgatggccacttgggttgcttctactttttggctattgtgaataatgttgttatgaacattggtgcaaatgcatctttgagaccactgctttcagttcttttggttatatatccaaaagtgggattgctagatcctatggtaattccatttttaattttttgaggaactgccatatttttcatagtggcattatcattcttgcaattttaagtgtgaagttatcttaaaataaaaattagaactgaaaaaaggaagaaagtgaaggaagctaatatggatatgcataaatattggctttagttgactttataattagataaaaattgatttttaagtttgttgaggccgggtgtggtggctcacacctgtaatcccagcactttgagaggctgaggcgagcagactgcttgagttcgaagttcaagaccagcctgggcaacatgatgaaaccctgtctctacaaagaaatacaaaaattagccagatgtggtggtgtgcacctgtagtcccagctactcaagaggctgaggagggaggatcacttgagcctgggaggtggaggttacagtgagctgagattgcagtgagcctgggtgacagagccagacccagtctcaaataaaaaaaaaatcattgataagctccgtgatattcaggataaaaagagaaacatattatttattagaaattagacaattgggccaggtgctttggctcacgcctgtaatcccagcactttgggaggccaaggtgggtggatcacgaggtcaggagatcgagaccatcctggctaacacggtgaaaccctgtctctactaaaaatacaaaaaattagccgggtgtggtggcgggtgcctgtagtcccaggtactctggaggctgaggcaggagaatggcacgaacccgggaggcggagcttgcagtgagcagagatcgcgccactgcactccagcctgggtgacagagcgagactccatctcaaaaaacaataacaacaacaaaaagaaattagacaattgagaccaagaagaaaatggaggaagtcactatggatttgtataagctctagccataattacaaaacctggctttcacacacctattagaatagccaaaatccagaacactgacaccaccaaatgctggcaaagatgtggaccaagaaccatcattcattgctggtgggagtacaaaatggtacagttgctttggaagacagttcagtggtttcttataaaattaaacattctcctaccacacaaggagttgaaagcatatccatatgaaaacccgtacataaatgtttatggcaactttatttgtagttgctaagacttggaagcaaccaagatgtctttcagtaggtgaatggataaataaactgtggtatgtccagacaatgggatattattcagcactaaaaagaaatgagctatcaactcttgaaaagacatggagcaaccttaaatgcatattactaagtgaaataagccaatctgaaaaggctacaaactggatgtatgtccagttatatgacactatggaaaggcaaaaactatggagttgtcttcaaaattagtcgttgccaagggctgaggagagggaaggatgaatggatatagcacagatgatttttacagaagtgaaactacaccctgtaatactactactaatggtaaacccatgtcatcatacatttgtccaaatccatagaatgtaaacttcccagagtgaaccctggtgtaaactctgaccctgggtgataacaatgtgtcagtattggttcctcaattgtaacaaatgtaccactctggtcgcggacattgataatcagggggctgtgcatgtgtcgggaacagggagtatatgagaaatccctgtactttccactcagttttgctatgaacctaaaactgcgatagaaaatagagcctgttaaaaaaacaaaacaaaacaactggctttgagctctctgatggctcaacatggtgaaaccctgtctctactaaaatacaaaaattagccgggcatgatggcaggtgcctgtaatcccagctattcaggaggctgagacaggagaatcgcttgaacctgggaggtggaggttgcagtgggccgagatcgtgccattgcactccagcctaggtgacagacagagggagactctgtctcaaaaaacaaacaaacaaaaaacagttctcaccagcattcacacattgctccattatccacatcctcatcagcttcgatgatcatcagctcatggggtttgccccctctgcgagaagcatcctggagcccattggctgctacctgctcccctccctccaaacagcgcttgtcttctgtccatctcagtcccctcaccttcaggctcctgggcatctccatgaaacagggaggcctaggagagctggcatcactgaatctaaaacctagaagaatccaaccagcacacatgccctagggagaggagatggtctaggtttagagagacagcaccaaacaagatggaacaaagtccctggcctctaggagcttatgttctgtattgatgatgagcacaggaagtgcacaagaaaaatcagggtaggtagggggtggaggctactactttgtgaagggtcattagagaacactttatgaagaatatgacattggtgagtacaccagtgagggagtgaaccctgcagatatcaaggccaagaatgttccgggcagaggaatgttccatgcttggcatggctaggtgacagcaaggaggccagtatgtccagaatggagtcaaaggagaaaaaagttgcaagaaggggggtggaggccagatcatgaccatgtgaagggagcttttggaaggttcttagcagagatctaggatctagaatctggctagactggggaagcaccagcatggaaggcgtcggggaggaaggcactgcagtgatccaagtaggagattatggaggcttggatcagagtggttgtggtggtgttgagatgggaccaatcctggccatattttgacggcagaactgagagggcttgctgttggactcaatgtgaggaatgggagagaatcaagaattactccagaaatgttttttgagcaagtggaagctgcttcctgagataaggaaggctgtgagggaagcacagttgggggtggatctcagaagtgtggttttaaacagtttacagcaaaaggatttaaagatgaagtgacctaatatacattaaaaacttaggacaggacaggcacggtggctcatgcctgtaatcccagcactttgggaggccgaggcaggtggatcatgaggtcaggagttcgagaccagtctggccaacatggtgaaaccctgtctctactacaaatacaaaaattagctgggcttggtggcgggcacctttaatcccagttactcaggaggctgaggcaggagagtcacttgaacccgggaggtggaggttgcagtgagctgagatcacaccattgcactccagactggacaacagagaatagagtgagactctgtcaaaacaaacaaacaaacaaacaaacaaaaccttagggacagtatttggtacttcatagcacacatgcatgtaaggttgacatttatctccattttaaaaataagattgaagtttcaagggttaagcaacttatgtactgtatctctttgagaccctgctttcagtccttttggatatgcagttgaaccttgaacaacatgagtttgaactgtgtggccccacttatatgtggcttttttttcagtcaaatgcagtggtgggatgccaaactgcagacagggagagccaacttttcatatatacaggttctgtagcaggacttgagtatgtacggatttgggtatacccagggattctggagccaatcccccagtatatcaaggtatgacttgaaagtggcattgctggatcatacggtagttctatttttaattttttgaggaactgtcctactgttttccattgcagttgcaccattttacaattccactaacagtgcataggggtcccagtttattcacatccttgccaacacttgtttttatttttgttttctttttttctttgtttttttttttttttttttttttttgagacagggtcttgttctgttgcccaggctggagtacagtggcatgatctcagctcactgaaacctctgcctcctgggttcaagcaattcttgtgcctcagcctccctagtagctgagattacaggcgcccaccaccacacctggctaatttttgtatttttagtagagatggggtttcaccatgttggccaggctggtcttgaactcctcacctcaaatgattcgcctgcctcagcctcccaaagtgttgggattacaggtctgagccactgtgcccggcctgatttttgttttctagaaagtctcactctattgcccaggatgaagtagagttttgacctcctcggttcaagtgatcctcccaccaaagcctccagaatagctgggaatacaggccatttctttatttctatcagaattggactcatggcttcctgttttattcagtgtgctatcatttgcattatatgagtcattctacattttgatgctcaaattgtgacagatttggccaatggaagccacttcaagctggcttctgtgtccttttgatatgtccccgtcattcttggagcactgtcttgattcctgccataacaggatatttcaagatgatcttgtactttctttgctgcagccctggaattagccatttctccaaggcccatggttccttttagtaaagaaccatgtttagaagcttctggccctggctttacccccgatgaaactcatggctttgaaaggcccagcatctgatctgaagaggcagaacaaaccattcattttactgaggagactgaggcctagatgtggtccattggccaagtccgcagccagtgacagagcttagacacgagctgaggcccctgacctcctgtccagtgttctctgcatggcaatacatattgctagctaagcggtctgctcccagcagggcctggccctctctggacctcacttccctcttgcggccactgagggttatctttgccctgggggtccaggactgcctgagagttgaccttagctcctggctcttgatgcgccttaccttcctggagacttttatgggtgaatccaccttaaattacagaagaggtcctgcttcagcttttatctccagcttacaaaccaatcccatcctgaaatgacttgtcgaagtgcatggacctggggggacacgtggtttgttccctccacgccagggattcaaggaatatgtgcctccctgaagcccatcttggtcagctaagacctgtctcatagaggagcatcaacaggaaagattgggtccaggcctgataccgggttgggaaggcaattggaaaggcctcgtctacctgccctaaggctcccaacccacccaggttacaccatcagcatctggggaaacagagacactaccgtcccacatccggaggccagtgtctcattagcctcacgtcaaagttgagaataagaaccctctatagtcatattctctatatgccattagagaatgtttgctgtgcctgatttggggataggttatgctgcatctgaccgatgccctctggtttggtcagccacgatagcaacttccagcctggaaatgcttgattattcaatcagtgcccttactagtgatgtcacaccaagcagcagtctgaaaggctttcgtctgttgtattcaacagacatttccaagcacctgctgtgtgtcaggcattacgttgcaccgttgttgcagaaattatttaaaccttagctcaatccaagtaggctttcaggtaacaattacgatgcaagtgggctccatccatatacaagaggaacaaggaggggcagcaaaagaaaggccgtatcggccgggggtggtggctcacgcctgtaatcccagcactttgggaggctgaggcgggcggatcacttgaggtcagtttgagactagcctggccaacatggtgaaaccccgtctctactaaaaatacaaaaaattagctgggcgtggtggcgcatgcttgtaatcccagctacttgggaggcagaggttgcagtgagcaaagatggcaccaccacactccagcctgagtgacatagtgagacgccatctcaaaaaaaaggccgtatcttctgacgttcagttctggcactcgggagtgtcaggttcttacaggcaagactttgtggagatactgaatttaagttgggctctgaagaatgattttgccaagtgaaactgtggaaagggcattacaggcagaaggaatggcttgagcaaaccacagaacctgtaaagtgcaaggttatcctgaacagcagagcacctgggtggcagtggctaacacccaggcaatggagggaggagtcaaagatgagaaattccagatacctcagagcccaagcatgaaggagcatgaacctgtgcttctgtagcgtatactaactctattctacaagcaacgagggcttaatacaggcttttaaaataacctttattttttaaaagttagtatgtgcattataggaaattgaaaaacacaagcaaagaacaaagtcattcacaatcacaagcagtttatagtttgacatattcttctagatcctgtgtgtaggcacaacatccaattttatgggactgagactgtacagtatgtatcatgatttttcacacatcatgaatatttaccaattcaaaatcccaaagctatatgagtattctgataaccaagaatacactacaccaactcaaactgctaaaaaaaaaaaaaaagatgtaatcctgcctttcttgggacagaaatttcatataagacaaaaatggcaacacgcctctagataaaagcattggcagagttctgatttaaatgctgcattcccttaatgctcaatttaaaatgaaacacacagcaacagaatacagtatgtttttaagagaattcattagcagatctataccattaaaatattagcaaagtgtatttccattgaattaatgtgttcttatagtacagccaagagatgcatacatcaatggctatcaaaatgtaaatatggacatatatggacacatctgcatacatctctacctgtataattccttctgcccctctgctgccaacctaatgaacaagtcctgacatacactgctcagaggtggcttaacaattccatgtccaagatgtatcctatcaattataacaaaggtatttacaaataggctaattcactagctctagtttttatcataagttgtcaccccattcgtaaagcttagatgttgcaaaataataactttgtccacaatgaacacaggcactttactaaaaacgctcttgtagacctgtggttatcatctaaaaccatcgtctagatatggagatactagcaaagagcccttcccttcacccttcctcttctccctcttccaccatccccgtgactaagtacaggatgtctagctccaaggggtggactaataaaggtcactcccagaggacaggccttcctaaaaactaacaaaaggacattcacaaagggactgatttactacatctatttttaacatactttgagcattaagacttatcctttaatacacaatattaactaaaatgcacatatagaacaatggttagaccatctgaactaatctcaggagcacagaacccctctccctgcatacctcctctgcccacccccccttcccccaccccaaacacccaatgaatagtctgcattcgctcctaagcatcaagttttaacaattccattcccaaatgcaaccactcctaggaagtactgaaaacaaatgcttagaggggtgttacttaagccctctactgttaacctacattgtgcacttttttttttgaaacggagcctcgctctgtcgccaggctggagtgcagtggtgcgatcttggctcactgcaacttccgcctcccaagttcaagcgattctcctgcctcagcctctcgagtaactggggctacaggtgggcaccaccacgaccagctaatttttgtatttttagtaaagatggggtttcaccatgttggccaagatggtcctgatctcttgacctcgtgatccgcctgcctcggcctcccaaagtgctgggattacaggcatgcgccactgcgacaggccgttgtacacttttaaacacctagaaagactagatgtttcaaactggacttaagttttccattatatacacagtagcattgaataaatggtatacatacataacacagactgtaatttgagtgtcttctaaataggaacattctggcctagaacccttccctttcccacctctaccaaccccgtggacagctataagccatctgtaatgcttagggggggttttaacaatttcacttgtttttaagaagtcttccctatgaattttaacacaaagtgtactcaatgtagtagtttactaattctacttttgtcatatactggcaacctttttaacatcgactagacgtaaattaggactcctatgtccgcttatatacactatatacacagcacagtaaatgaaaatgcagacataagggacaatggtcaatgtgcctcctcataaacacactggacactggtagaaagccctttgcactttgtgctcctccttccccctgaaccagcacaaatatcaaaatgggtactgctcagagaattgatcaatttccaagacaatatttcatatcaaaaggatagctacaaaatgtgttatttactacctctacttttaacatactttgtgcacttctaaacatctagaaagactagatgtttcaaataaggacttaagtttgtccgctatatacacagtagggttgaataaactacacacatgtaacaatggttatatctgatagtgtcttctaaatacgaacattctggtctagaacccttcattccttccaactcctctccaccaccaacctgatggatataggcacgtgtcacttagagctgatgttatctcacttccaaaagtccttttcagaagacagcctttctacaaattttaacaaagtgtacaaaatgtgttagtttactaactctacttctgtcatacattggcaacctctttaatatctagagactagatattataaaatcgggactaatttgtccgttatatatacaatatatacagtatagcaaagttaaatgaaatgcatgtaacatatacacaatggattaagctgaaattttctaataaacaatggcaaaacaccatttgcaatttcttccctcccacctcccaggtggttcaacaattccacttccaaacagcatttcccatcagtttttaaaagctatttacaaagtgttattctactaccacttttaaatacatcaagcacttccaaatatctagaaagactagatatttcatataacttgtccaccacatacacagcactgttaaataaaattgcacacacataacaatggttatcatctgaggtatcttctaaatgtggccattttggccttgaatcattccctcctcccttccttctctgccttcaatccagtggacaagtacaggcacgtgtaatgcttagagatggtcaaacaaattcctatgcaaaagtctttacagaagacaagttttcctacgaatttcaacacaaagtgtacaaaatatgctaattttactcctttgtcatacactggcaacctctttaacatctagagactagatgttgaaaaattaggactatttgtccattatatatactatatacagagcaaaacaaaatgcacaaaacatatagaaaaatggtgtctgaaaatgtccaagtatgaacacactagtaatattaccttttgcaatttcttccctcctacctcctctaaactattgaacaagtatagacattactatactgttcacaaaggtggcttcacaattcaatttccaaaagcatttcctatgaattttagcaaaaagatatttacaaagtggtattttactacctatacatttaacatacatcgggcacttctaaacatctagatagactagatgtttcaagtaaggagttaatttgtctactatgtatacagcagtcttgaataaactgcaaacatgtaacaacagttataatttgaaagagtcttccaaatgtgaacattctggcctagaacccttcccatctccatcaacccagaagacatcaaattttcagaagacaatctttcctaggacttgtaaaacaaaatgtacaaaatatattagtttactaactctacttttgtcatacactggcaacctctttaacatccagaaagactagatgttgtcaattaggactcgtctgtcctttatgtacactatatacacagataagtaaaacaaaatgcacagacataatgattcatcttgcctcgctgtaaacaggatggcatagagctctctgcacctccccctcctctctcctcccctgaaccactgcacaaacacaatgagtattactcaacaggtgatttggccattcccccccaaaaatatttcctatgaattgtaacaaaaaggtatttacaaaatgtgattttgctacctctaattttaacatatcaggcacttcagaacatctaaaaagaagagacatttcaaaaaagcttagcattgtcaactatatacacagtagtgaggaataaaatgcacacaaaacaatggatagaatatgaaaatgtcttctaaatatgaccagtctagcatagaaccttcttctcttccttctcaggtcttccagctccatgtcatctaacccacttaacaaacgtggacgtatcgcttccagaggccgtcttaacaactccatttccaaaagtcatctccagaagacatgtattttctatgatttcttttaaacaaatgagaatttacaagatgtgtaactttctaactctattttatcatacgtcggcaacctctttccatctagaagggctagatgtgacaaatgttttctattaaaaggttggggtggagttgagagcagctttttcatattatatacacaggccttccataaacggccagtaaatcttcccagagggtggtgggcatttccaacgggccaaacgtggcctgtcattctaccatttctctcttccgacagcaaagtctggtagaatgaagaccaaccgcccgatggccgctaaccgttccacccgtcgtcgttcgggacttcgctcaccttccaggccccttaaggcctttgtccgttgtcgtcaggactaggtaggtctcgcccaatggcgacagagtggtcacccgggaaccggatctgcgcggctccgtggcctaaagaggcggccgagcctgcttgcgtccctaggccgccttcccgggccgtccacgccttaatggcctccgccgcgcggcgttcgagctgccgccatacttcccggcccaccacgcccagcgccgcccaaaggcgctgcgtcccggcggctctgcgggggtttcgtcgaggcttgggtcgggagacccgggtgccggcggggtccgggctgggagacgccacggccgccattagtcaccgaggtggggtgggaaagagaggttcgctgcggcttcaaggtctgggcacagccagtgggcgggcacagccagtgggcagccacagcagaggcctccgttatctgcagggcagagggctcggcctgtcccggggccccccagttcacccgccggcccggggccggagggcctggagggccctggaggagcgggctgcgttctgcgtctctccgcgatctctgccggaccggaactgacttggcagttctctgcgctggcaagagaggagcggtaccggaagtgcccttgcgctgggggcccgcgagccgtggttccgggtctgcaatgttccggcgtgggggtggggaatggggaatggggtgtggtcacgtggggttagggccccctccaccccgcttgctcttcgcaacggaaattgctactggcctcagaattccctgagcaaacgttgcttctctatctccttactcctccggtgctggataagaagactccaatatttcatttattgactcatttaccacctgtttaccgagcacctatgtgcctctaagcacgggggagtgcagcagtaaagaaaaaaacacaggaaaatttctgctctcctaaaatttacattctagtaagggaaacaacaataaacaagatccttaaaatgcataaaagggtagatagcgaaagtgctttggaaacataaaaaggaaagaggaatatgaagtgcaggtgcggaatgctttatagtacggccaggtgactctggagcagagacccgaaggaggcgaggggatgagccatgcttggagatgtctgtaggggaacagcttatgcacaggccacaaagccgaagcatgtgggccaggcctgttccaggaacagcaaagaggctggggaagagaggagagaaatgggaccatgggagggagttgaactgcagtgcgggagagctgaagtggaggcaggggcagaagcagggagacctgataactgactgttgcaatcaagcaggtgagctatgatagggacttatgccagggcgacgacagcaaagggggcaaaaagtggttgaattcaggggttgacataagctcaagtctataagatttgctgacggaccagatgtgaagtgggagagcgagaactgaaagatgactccacactttttggcctgagcaaatgaaaaggcagccgccttaagtgagatggaagaaaccatgggaggagcaagctttggggagaacaccaggagctgagttttaggcatgttaagtttgagatgtctgtttgacattcaagtggaaatgtcaagcagacagatggatttatgagtctggcattcagggaaaggtttgaactggagatgaatctttgggagtcgtcagcatatagatgtctttaaaaccttgaggctgcatgagagaaccaagagagggacaaggtctgaggtctgatccctgggtaacgtttacaggtcagggaatgagaaggaaccagcaaaggagactgagaagcgaccagggtggtaggagaacaaccaggagagtgtggtgtcctggaagtaaatgaggaaagtgtttcaaggggaatttatcaacagtgtcaaatgctgctgatgtgtcaattaagataaggttggaaatgacacttccagcttttagaattaatgctgtgatgaacttcctcgtgaattttcacattttgtgtagacttctgaattcctttgggtttttttgttttttgttttagatggagtcttgcgctgtcacctagtctagagtgcagtggcgcgatcttggctcactacaacctccacctcccaggttgaagtgattctcctacctcagcctcacgagtagctgggattataggcgcccgccaccgcgcccagctaatttttgtatttttgagtagagacgggggtttcaccatgttggccaggctggtctcgaacttctgacctcgtgatccacctgccttggcctcccaaagtgctgggattacaggcgtgagccaccgcccccagcctctgagttcctttgtttgtatttgtatttttattttttttttttgaggcagagtcttgctctgttgcccaggctgtagtgaaatggtgcgatcttgactcactgcaacctccacctcctgggttcaagtgattctcctgcctcagcctcccaagtagctgggattacaggcactcgccaccaggccaggctaattttttgtatttttagtagagacggggttttaccctgttggtcaggctggtctcgaacttgtgacctcaggtgatccacccaccttcgcctcccaaagtgctgggattacaggtgtgagccaccgcacctggcctgcatttttattatttttaaaattatttatttatttatttatgtttgagacagggtctcgctctgtcatccaggctggagtgcagtggtgccatctcggcccactgcaacctccaactcctgagttcaaatgattctcctgcttcagcctcccaagtagctgggactacaaacgtgtgccaccatgcccagctaatttttgtatttttagtatagatgagatttcactgtgttggccaggctggtttcaaactcctgacctcaggtgatccacctgcctcggcttcccaaagtgctgggagtacaagcatgagctaccaccactggccctgagttcctttggatacaattctggaaatgtaaagaaagatcaaaggattaagactcttgatgcagactcagacatgattcccaggaggaaaatcctgcagtcagaaaggccttgctggtggaaggtggacaggagaggtggcgagaagtccaggggctctagtccacaatgagatgacaaggccctgagccaggagagttgcacagaagtagaaaaccggtgaagtgagtgtttctagcatttcaagagaagaagccagtgggctgaatacctgagagaagagggaggaggggaaggaagagccatggattatacaagtttcaaacactagcgctaatgggtagtttggtagttgatacattagccaagacaaggagtaggagaggctcctggtcccctttctgagcttcccaccgcctaagcagccaaacatgtgggtattcctggaacctaaagatgaggatgatgaaaaacatgtatacatcctgctttctttttctttttcttttattattttttttccgagacgcagtcttgctgtgtctgggctggagtgaagtggtgtgatctcggctccctgcaaccctcgcctcccaggttcaagcgattctcctgactcagcctcctgagtaactgggattacaggcacgtgccaccacatccctttaatttttgtattcttagtagggatgggatttcaccatgttggccaggctggtctggaactcttgacctcatgatccgcccacctcggcctcccaaagtgctgagattacaggcatgagccactgtgctcagcatacattctgctttctacctgatagctctacttgaatgttccaacagtatctgaaactcctcttgtgcaaaacaaaactcttggtatctccccagagcctgctcttccctatcagtaaatggcagtatcatccacctgtttcccaagtaatatggtttggctgtgtctccatccaaatctcatcttgaattgtactcctataattcccacacgttatgggagggacccagtgggagataatttgagtcatggggtggttccctcatactgttctcatggtagtgaataagtctcatgagatctgatggttttatcaggggtttccgcttttgcatctttctcattttctcttgctgctgctgtgtaagaagtgcctttcacctcctgccatgattctgagacctccccagccatgtggaaatgtaagtccgattaaacctctttttcttcccagactcgggtatgtctttatcagcagcgtgaaaatggactaatacaccaagtaattctcgatctcccttgattccccattctctcacttcccacacggcaaccatccccagtcctatctgcctcctaaatatatttcaaatacagccaattccctgtgctgtccattatagtagccactagctacgtgtgcctatttaaattgtaattcattagaatgacatgaaattaaaaattcagttcttcagccacaccaccctcattccaagtgctcaagagtcacagggaactaggagccagtggctaccatatgagcacaggtggagaatgttcccaccatcccaggaagtcccattgacagtgctgatctgtatccaaatccaagctagcaacgtctttcatttggatgactctaatagccccttaattgttgttgttctggtttctactgctctccctttctaatccgttctccctacagaagccagaatgaacttttaatcaaaaatcagatcttataactctcctgtttaagccttcagtggcttttcatcacacttagaacaaaatcaaacttatttccacgaccactgccttccatgacctgccctttgacctgccctttgtgtccctcgtgcctcatctttgtttttttttttgtttttgtttgagaaggatctcaatctgtcacccaggctgcagtgcagtgcagtgcagtggtgtgattatggctcactacagcctcgtcctccctgggctcaggtgatcctcctgcctcagactcccaagtagctaggactatagacacacgccaccatgcccagctaatttttatatttcttgtagagagagggttttgccatgttgcccaggctggtcttgaactgagctcaagccatccaccctccccagcccgtcccggcctcccaaagtgctgggactttaggcattagccactgcccccagcttcatgccccatcttgagccactctctccctgtctcgttatatgccagccacgctagtctccttgctgttccttccactctctgagctcttctctgcctcagggcctttccacatgctgtctacctggaagactcttcacctcttcactgggtttggcaaggctaagtttcttctcatcctataggtctcagctccaatgttatctctttagacagcctttcctggccgccctttctccaggcggtctcttccagttatcatcacattgccctacttatttccttccttcatttttcaaaaatctcattattttattaatagtaatgaacatttctgcacatttcttatatgcaaggcactgtactgaggacttggctttatatgcctcactatatttatttatttattttgagatggagtcccactctgtcacctaggctggagtgcagtggtgtaatctcagctcactgcaagctccgcctcctgggttcaagcgattctcctgcctcagcctccctagtgtctgggattacaggcatgcaccaccacgcctggctaatttttgtatttttagtagagatgaggttatgccatgttggccaggctggtcttgaactcctgacctcaagtgatcctcctgccttggccccccaaagtgctgggattacaggtgtgagctgccacagctggcctgctttgtctatttttaatttaattaatttaattttgagacagggtttcaccctctcacccaggctggagtgcagtgatacgatcgtaactctccacagcctcgaattcctgagctcaagagatcctccttctccagcctctggagtacctgggactacaggagtgcatctccacaccctggctaattaaaaaaaaaaaaaaagtttttttttgttgttgagacagagtttcactttgttgcccaggctggtcttgaacacctggctctaagcaatcctcccacctcagcctcccaaagtgctgggattacaagcatgagccaccatgccctgcctatctattaatttactagtttattttctgttctggttttcacctatgtccctggcactcagcacagtgcctggtatgcagtaggcattaataattgtaaagaaattaattaattgagcacatactgtgggccaagcactgtgctcagcactgtacatatattgtctcatttaacctgcacagcaatcctgtgaagtaagtgctactactctcctccttttacagaggagaagctatgtcacttgtctagttctcagaaaaaaactaggattttaatccaactcatctgactcccaagctccctgggaaggcactataggggatttagaagtctgagtacacacagcctgaaaccacccacagctcagactagcagcagggaaactaaagtattcctttcttgaagggctttctatttcagatcaggccacagattctggtgtgtcactgctcaatcaggaggcagattcaggacctgggtcagggcttaggcttggacagagtcaagaaagctaaatggctgggtgccgtggctcatgcctgtaatcccagcactttgggaggcggaggagggcagattgcttgaggccaggagtttgagaccagccagaccaacatggcaaaacctcgtctctactaaaaatacaaaaatgaagctgggcacagtggtacacgcctgtaatcagcactttgggaggccaaggcaggcagatcacctaaggtcaacagttcgagaccagcctggtcaacacagtgaaaccccatctctactaaaaatacaaaaattagcctggaatggtggctggcgcttgtaatcctagctactcgggaggctgaggcaggagaattgcttgagcctgggaagcggaggttgtagtgagccaagatcacgccactgcattccagcctgggcactgagcgagactctgtttcaaaaaaaaaaaaaaaaacacccaaaacaaaaacaaaaatgagccagtgtgatggtgtacgcctgtaatcccagctacttggaaggctgaggcaggagaatcacttgaacctgggaggcggaggctgcggtgagctgcaatcgcatcactgcactccagcctgggcaatagagggagattctgtctcaataataataataataataatggctgggcatggtggctcatgcctgtaatcccagcattttgggaggctgaggcgggtggatcacctgaggtcaggagtttgagacttgggaaacaaaggcagtgcaacatctgtaccttcccgggcctgggcatacagtcccaccattattgctattagcatttgtctgcactgaggcagatctaattgtcatcagggctctggaaaacaggtggtgttgggggggtgtcccataaagtccacttaggatcatcattatttttttattttttattttttttgagatggagtcttgctctgttgcccaggctggagttcagtggctcgatctcagctcacagcaagctccgcctcccgggttcatgccattctcctgcctcagcctcctgagtagctgggactgcaggtgcctgccaccacacccggctaattttttgtatttttagtagagacggggtttcaccgtgttagccaggatggtctcaatctcctgacctcatgatccgcccgcctcggcctcccaaagtgctgggattacaggcatgagccaccgcgcccagccaggatcatcattattatcattgcttgaacgtgggatttggttttgccctactacagtttctcaaacttgaatcgtttctaaatcagcctaacaactttttccatatccatgtaccacaatgtgtcagtccattcaggcggttagaacaaaataccatcaattgagtggcttataaacaacagtaatttatttcttacagttctggaggctgggaagtctaagatcaaggaaatggcagattctgtgtctggcgaaggcccagtttttttttttttttttttttttttttttttttttttttttgagacggagtcttgctctgccacccaggcaggagtgcagtggcacgatctcagctcattgcaacctctgcctcttgggttcaagcaattctcctgcctcagcctcctgagtagctgggatcacaggtgcctgccaccatgcccagctaatttttgtatttttagtagagacagggtttatttctttctttttctttctttctttttttttttttttttgagatggagtttcgctcttcttgcccagactggagtggaatggcgcgatctgggctcactgcaacctctgcctcccaggttcaagcgattctcctgcctcagcttcccgagtagctgggattacaggctcctgccaccatgcctgctaatttttgcatttttagtagagacggtattccaccatgttggccaggctggtcctgaactcccaacctcaggtgatccgcccaccttggcctcccaaagtgttggaattacaggcgtgagccaccgtgcctggcccggcctcttttataacattgatcccattcatgaaggctcttctcccacgatctaatcacttcctaagggccccacctcttaataccatcactgtgggggttaggatttcaacataggaatttgggggtgaggggtcacaaacattcagaccatagcacatcagtaccagtttctacttaataccgctctatgaattgactaatttcgcccaactgttgctacattaaccttgtcctcagcagtatttgtgaaatcatcaagttgacatgctagttatatgttttcctaatatacattaaagtaaatatataactctttaaaaaatgttcttctgggttgcacttgaaatcatctcggtgcaaccagtggaacccaaaccacacttagcaaagcaattagtgtcaaagggacacaggcaacagccgaaaaagctcccaaccaggcgcagtggcttgcacctgtaatcccagcactttgggaggctgaggcaggtggatctcctaaggtcaacagtttgagaccagcctggccaacatggtgaaaccccatctctactaaaaatacaaaaattagccaggcatggtggagcacgcctgtagtcccaactactcgggaggctgaggcaggaaaatcgcttgaaccccggaggcggaggttgcagtgagctgagatcgcgccactgcactccagcctaggtgacagagaagactccatctaaaaaaaaaaaaaaaaaaagctcccaatggccaaagctggaacaatttgagcaacaaaataacatagtattgggataaagttcaaagtataaaccaaatatccatgagtccatactgttataaatgattaaataaataaatgagggagggctgggcgcggtggctcacgcctgtaatcccagcactttgggaggctgaggcaggcagatcacctgaggtcgggagttcaagaccagcctgaccaacatggagaaaccccgtctctactaaaaatacaaaattagccaggcgtggtggcgcatgcctgtagtcccagctacttgggaaggctgaggcaggagaatctcttaaacctgggaggcggaggttgtggtgacccagtgttgtgccattgtactccagcctgggcaacaaagtgaaactctgtctcaataaataaataaataaataaataaataaataaataaataagggagaagagacaaatgatccttaaagaagaattctagataatgtaggtagatacaaccccttcaggttgtggagcttaattctcccattgagtgtgggctgcacttagtaacttgcttccaaagagtggaaagggaggaaaaacaagcaacttcccaggggagaaactggacagacactcgcttggccaggtaatcaagtcatgtcgctaacatgtatcctgatgaagtcatgtcaataacatgtacctatgatttgatgagaagagcagtttacctctatgacatgtttccccaaactcataaccccagtctaactatgagaaaagcatcagatgaacccaaattgaggggcactctgtaaaatacctgtccagtactcctcaaagctgtcaaggtcttaaaaaccaagaaatgcctgagtaattgttacaagccagaagaaactaaagggacatgatgactaaatgtagtgtggtgtcctagaagggactctggagcagaaaacaggtggaatttagttcataggaatgtaccagtgttggtttcttagttgtgacaaatgccatagtaatgtaaggtggtaataataggggaagcagggtgagggctatacaggaactctctgtactcttgagtatgatggttaagttcatgtgtcaacatggagggtggttttggatgatattagcatttaaatggttgaacttgggtgtgggcgggcctcatttgatcagttgaaggcctgaataaaacagaaagactggcctccctaagcaagatggaattctccggcaggctgccttcaaactgcaccattggctctcctgggtcatcagcctgcaggcccacactgtgggattcgggcttgccagccttcataattaggtaagccaattctttatgataaatctcttttatgcacacacacaccgtattggttctctttctctggtgagccctaacacaatgggaaatttctgtactctaaatcaaagacttacatttattttctgtaaatgtaaaattattttaaaataataagtttattttaaaaagagagaaggctgggtgcggtggctcatgcctataatcccagtactttgggaggccgaggtgggtggatcacctgaggttgggagtttgagaccagcctggctaacatggtgaaaccccatctgtactaaaaatacaaaaattagccaggcgtggtggcgcatgcctgtaatcccagctacttggaaggctgaggcatgagaattacttgaatccatgaggcagaggttgcagtgagccgagatcacgccactgcactccagcctgtgcaacagagcgagactctgtctcaaaataaataaataaataataaaaagagaaaaaaagaggcatgaattttgaagtcatgtagatccatttatttgtttcctgtgggtgccaaaacaaattactacaagcctggtagcttaaaacaacagaaatttattctctcatagttctggaggccataaattgaacatgagtttcactgagctgaagtcaatgtgttggcaaggctgtattccctccagatgctctggggaagaatccgtctgcctcttccaacttctggtggctgccaacaatccttggcttgtggccacatcagtctctgcctccatggtcacattgcttcctcttcttctgtgtgtgttggtctaatcttcctttccctctctcttataaggatatgtgtgatggaatttagggcccacttggctaatcctcaatgatatcctcatctcaacattcttaatcacatctgcaaaaattattttctcaaataaagtaatgtttacagtagtttccagagattaggacttgatatatttgggtggccattattcagcctactacaccctggctgtgtgaaatgtaggacttttgtagtatgagtaagccggctctatacttaaaaataaaaactatgacataacctggttttaaaaaatgttcatctgggttccacctgaaatcatcgtattatgaccactagtgaggtaggaggcaggactcgagtctggaggtggggttcagacactggaccaaattgaggactagctaaagcagggatggggtagaagaagctttccataagacatgcccaccagtgtgccatgccagtttaccattgccatggcaacactcagaggttactgccctttccatggtagtgacccaagaccaagaagttaccacctttttcctagaaatttctgcataatctgcccctgaatttgcatgtaaataaaagtgggtataaatatgactgcagaactgcgtttgagctgctactctaggcacactgcctatggggtaaccctgctccacaagaagcagtacgtctgctgctgccgaacactgccacttcaataaaagttactatctgacatcactgacttacccttgaattctttcaagtcaagaaccctcctgggctaagccccaattgggatcacctgccctgccttggtgggacccaagccacactttgccaaacagtgtaagagattggtcttagaggtcagagagttctacattctaactctggcaagcctgtgactttggttaagtcaacatattccttgaagactatctcttcatctgtacaagaggacactagccctgactcagaggaatgctgtcagaactcctgcagactgtgaaacagatgcacaacaaatgatcagtcacattctcctccccctccattttatagtttgttacacttcacaaaatattttctacatacaataatgtttgatccccataaaatgtgtgagataaagccaaacgtttccttctcagatggagaaactgagacttgatgtcaactgacttagccaactttgcctaactagaagactagaagcagtgggtgtctgagagcatagtcagcagaagcaaagaggcagatgccccccggagatggggcaggtttgctgatctggcatttgatttttttttttttttttttgagagggagcttcactctgttgcccaggctggagtgcagtggcgcaattgcgactcactgcaacctctgcctctcaggctcaaggtgattctcctgccttggcctcctgagtagctgggattacaggcacccaccactacacccggctagtttttgtattttcagtagagacaggctttcaccatgttggccagactgctcttgaactcttgacttcaaatgatccacccacctcggcctcccaaagtgctgggattacaggcatgagccactgtgcccggcctgatttttttttccatgattttcattacctttctgtccccggtaggcatttgagtttatgatccatgatatgttcctaactctggttcacactgctataacttgatcatagacttttggacttgaagctgtaatactcctggggttccccagtgacagcccacccagttttccagtggcttcttggccctggcttctctgatctcacaggcttccccttcttctaaatattgcaaggcaaacccatagtttgtcctctggtttgaccaggttcttggttctgatagccccttattctgagccttccaggcagagactcctacaggactctgccacctcaggacccagcatagggctgggtgtcctgaaggtctgctaaggggactcatgctgagccttcggaaggtcacaaggagagaacagagggtgggctgagggtccacatgccaacatgtcaggagttggactgcttgggttccaatccggctcccgcacctcactgcccctgaccctgggcaaatcaccaaaccctttgtgattggtttcctcatctgtaaaaagggaatcattatagaaccccaaagcaaaattataaggctcgggtgaaatactgtatataaaccttttattacagggctgggcacaaggtgagtgctcgccttgacattgttgcgccagatttccctaagcacatcactgcatggctgttctctcttctggatacggccgccctttctgcctagagacgtttgattcttcctggggggcggtgcagggtcaggtgagcagctggggctccggagggtctgggtctctgtcacttcttgctgcgtcgccttctgtgagtccttcccagccccctaatcatgcccgcctgagcaagaggatgagaaaatgccgaccccgtagcggggactctgctgctgtgcggggcgcggttcgccgaacccactggccgcttctagagagtcggccccagggccaggacctccacttggcaggcgctggggcgcccaggggcagggccagcgcgggaaaggccgcgagtccttcgaccccctggcagtctgggagccggccgcggctgccatggcaacgcccggaagctgccgggaggggaggcaggcccagccgggacgaggccctgcctccagccaacgctccgcccagaacgaagccccgccccggaacgaagccccgcctccagcaactctctgcccggagagaggcccgacagctgcgacccgactggttctgtccgagcccgacgggccgcgctgacccagcgactgtgcctgactgaccacaggtgccgccaccgcctgataatacgagtgtgtcagcttccgtctgactgaacgcaggtttcatgggtgcctgacagaccaagactgctggatctgtcagcctggccgcagctggctgactggctgactggctggctggttgactggctggctgactggctgcctggctggctggctggctggctgctcttgcccggccgccatctgggcctgacgggctgcgtctgaccgggcggcctatctgcctctgcctgaccagcctccatctgtgcttggcgagctgtgtgaccggccgcgacggtctgtgtctgactgagcacaaggttcctagcggccgatcagctgcttgaccccatctctgctgagccggccgacaccgacggattgactctggcaacgcctggcccgagtggcgctaccggcttccagagacttcctgacccctgccgaggttgcaccgctcagcgctgccctgtgaggcgctgactgtggccgcagctgagtgcggctgccccttcacagacagggcgtgcagaatgacggtcgcctggctgtccctccctaggcgcccctggctagctcggcttgcctggcagcgtctgtgtctgagggacgtgttggtggccgccgctggccgcatctgtccccctgcaggtgggcatcaggttgcccccgtgaagtgcagctggggccgagcctggctgaaggacggccaccttctctccagctgtccagcgagggcttctgaggtggtgccctccggggctctgtggcctggacctctccagccacacacagtcagagccttaggggatcccaagcaagggcacccacagggaagagagcctaagacagaggccaagggacaggcaggcagcaggggtgggacttcgggccaggcgaggaacagctggaagaagctccggggctgggaggaggccgcaggaccttgaggtgccggagtttagggatccgattctgtaagggaggcagcaccttgaggagttgggttggtgtgtggggtcctcaggacacgatccctgactttgaatacctttttttgcgggttttggggaaatctctgtcagtgccttgctgctctgcagaagggtcatcccgcagacctcagatctcttcccgaattaattaatttatttatttttatttatttttttctttttttgagatggagtcttgctctgtcgtccagcctggagtgcagtggcccgatcttggctcactacaaactccgccttccaggttcaagcgattctcatgcctcagtttcccaggtagctgggattacaggtgtgcgccaccatgcctggctaatttctgtattttagccgggggtttgtagagacagggttttgccatattgcccaggctggtctcaaactcctggcctcaagtgatctgcccaccttggcctcccaaagtgctggggttacaggtatgagccactgcacccagcctcttcctgaatttaaatctctcccagcctgtgtgtgtgtgtgtgtgtgtgtgtgtgtgtgtgtgccagccacaccaaccacatgcaatggcttcccccctggaaggagttgttctgtaccagaataagggggaaggaaatactggtcagagggatttatttttttaaagcaagcatgggtatgctatgagttattgctattaataataatacaatgaaagcatcagactagtttatttcgaactagctctagcatgctaagatgttgcctctccattaataacagggccctggctgcctcgttgatttcattataggccatgggaggaatgggaggaaatgaacagcttcactcccaagggctttcataacatggatttggatctcagccagtgtgggcagtggggcttcccgggggcaggggactcctggggtgctgggaaaaagaggcagcaacaagttgcatggagcatttgtacctcatttatttattcatttattcaacaaatatttattgagtaccatgtgccaggcactgtgccagactctcactctgtcctcatggaggatagccttatgggatccaggaaacctctccagtgcctcccaactctggtcctgtcaaagccacatgctgggtaccaactgctttctttctgagctagctgcacagctaaaatgggagagctagtagagtacagtggtcctgaaattgtggtccttggacgagcagtatctggaccacctgggaacttattaaaatacaaattctcaggtcaggagatcgagaccatcctggctaacacagtgaaaccctgtctgtattaaaaatacaaaaaaattagccaggcgtagtggcgggcgcctgtagtcccagatacttgggagactcagacaggagaatggcgtgaacctgggaggcggagcttgcagtgaaccgagattgcgccactgcactccagcctggatgacagagcgagactccatctcaaaaaaaaaaaaaaaaattatcgggccctatctcagatggactgaatcagaaactattttagtgtagggcacagtgatctatgttttaacaagcctccaggtcttgctgatgtcctgagaaccaggacaaagtcgtgctaaagtctgagaaccactggtggaataattaattgtgttggctctagtatcacactgtccatatcagaatctcaatgctactacataagagctgtgtgactttgaccaagttattgaatctttctgtgccttaattttctcatttgcataattggtataattatgattaccctaaaccattgttgtacatattacatcacgtgaaaaggttagcgcacaatttcagctctaggaacatatcctgtggacatatttcttttctttctttcttttcttttctttttttttttttgagacagtttcgcttttttcacccaggctggagtgcaatggcacaggcttggctcactgcaacctctgcctcccgggctcaagcaattctcctgcttcagcttcccaagtagctgggattacaggcaccctccaccacgcccggctaattttgtatttttagtagagatgggggtttcaccatgttggccaggctggtctcgaactcctgacctcaggtgatccacctgcctcagcctcccaaagtgctgggattacaggcatgagccactgtgcccggccctgtggacatatttctgcatatgctgaaagacaagtgtaagggatattcattaatttgttgtttataaacacactatttatttatttatttatttttgagatggagtctcgctctgttgcccaggatggagtgcagtggcacgatcttggctcactgtaacctctgcctcccgggttcaagcaattctgcctcagcctcccaagtagctgggattacaggcgtgcaccacggcacacagcgaaattttgtatttttagcagagatggagttttgccatgttggccaggctgatttcaaactcctgacctcagatgatccacctgccttggcctctcaaagtgttgggattacaggcatgagccactgcgcccagccaatgcattcatttctgtaaaaaaaaaaaaaaaaaaaaaaaaaaaaatctttataaaatctttttttttttttgagacagagtttcactcttgttccccaggctggagtgcaatggcgcgaactcggctcaccacaacttctgccccctgggttcaagtgattctcctgcctcaacctcccaagcagctgggattacagtcatgcaccaccacgcccggctcattttgtatttttttaatagagacggggtttctccatgtcggtcaggctagtcccgaactctcaacctcaggtaatccgcccgccttggcctcccagagtgctgggattacaggagtgagccaccgtgcccagcctataaaatctttatacagatacaggctcatgtacatctgaaaggatactcaaggaactggtaacagtgggagaagaaatgggtggctggaaacaggagaagggaaacatttttaccatacatacacccttttatgacttttagattttgcagtatgtgcatgcattttctattcacaaaaatgaaattttttaaaaaagggggcagtacttagcacaatgcctagcagtggtggcggtggtggtgatagcctttctgcagctctgggcagatgattcactgcagaaatgcagcccagagatatctagaggctggccatagcctccagactgtcctcctagcctctcggtctcccttcttcattctatatgatccatgtttccccatcggagaatctttgcattttagagatgtaaaggggcttcagattttctagtgcaactgttttaacggtgaagaaactaagcccccaaaagatgccataaccagtccaaggttatcaacagggttcaatctagggcctcttttacaccatcctaagttttctaaaattctgctgtcattccatcactgctctgcccgtgaatcctcaacctggctattaagactagctgtggtctaggccaagcacagtggcttatgcctgtaaccccaacactctgaggccgaggtgggcagatcacttgaggtcaggagtttgagaccagcctgactaacatagtaaaaccctgtctctactcaaaatacaaaaattagctgcgtgtggtagtgcacatctataatcccagctactcgggaggctggggcacaaaaattgcttgaacctgggaggcagaggttgcagtgagctcagagtctcgctctgtctcaaaaaaaaaacccacaaaaaactagctgtggtttaactcccaaccaaatttccagccttatttgccacccttttcttctatgtgaatcctctaccttagccagatagttctctttattgactccaaatgctcctgctttccaaatgccatactctctgcctgaaatgcctttctctttcctgtccatttattgtggagattctacctaaacatggaagctaagcttaaatcatacttccttcaggaagtcttccctgattacttcagctcacagagctgtctccctctgaactagttaaaaaagttcttgtggctgggcgcagtggcttacacctgtaatcccagcactttgggatgtcaaggcaggcggatcacttgaggtcagaagtttgacaccatcctggccaacatggcaaaatgccatctctactttaaaaaatacaaaaattagctgggtgtggtggtggtgcatgcctgtagtcccagctactcgggaggctgaggtaggagaattgcttgaacctgggaggcagaggttgcagtgagctgagatagtgccactgcactccagcctgggtgacagagtgagactccatctcaaaaaaaaaaaaaagttattgtaaaaaactcctgctccttaagagggacgtaggatgtttgtctgcttcttgggtaatgggaaattaacttggatagagctcattcctcattctctatttctgcagctataaaattgggccaataaccttagccctccttattgtctcaggaaagccctgggtgaggatgccactgagcccgcctggagccaggagctggtctgcagaaactgctgggcctgtttctactctgatgtttacttggcctggaggcccagtgtgatgaaacccggccctgttgccgagcaccttgggaagcctccctccagggtccctctgtgctcagacagtggccctttgtagagtggaggagcagactgaaagcggagctgctggaaaccgtttcctcccctctgcctcgagcaacctcctcccgcagccacagaccatcctgtgcctgggtggcctctgctttaagtctgcagctggcggggtaagatagggtctctaggcagcctgctaggctggaagggtgaggaggggtcctggcaggatggccagctgaaacacagcatcccctaactcaatacagatcacttataacagggctttccaaagaggagactggccccttacaggcaagattgacatttcaccatcccctgccaccactcaataagcgcctaagatttaggctagaagtgatgtggtttgtcccttctgtccctacttcactggcccctatactcactagcgggggggattgggaatccttagacataatcccaaacctggtggagtaggagttcagtaagtggggaagaactaggaacaagaggaaagaaggtttaagagtgtggtataggctgggcacggtggctcatgcttgtaatcccagcactttgggaggctgaggcaagcggatcacttgaggtcaggggtttgagaccagcctggccaacatggtgaaaccccatctctactaaaaatacaaaaattagccaggcatggtggcgggcgcctgtaatcccagctcctcaggaggctgaggcaggagaatcgcttgaacccggaaggcagaggttgcagtgagccaagatggcgccatttcactccagcctgggcgacaagagtgagactccgtctcaaaaaaagtgttgtataggtgaaaggacacttaactggtctggggggcaggaagcctgggattccatttctgctgagctactgacttgctgggtgacattagctagttgtttcccttttctatgcttcagtttcccagctgcgaaactgtggaggtggagtaaataaatgttaaggatttttgcagttctaatttttcccaattctttgatcagaaggaggaaaggaaagctgggggtgggttggaggtaaataactggcaggatgccttccatggattcacctgcagtctccaggcagcttcttctctgccactaagatctcttccccttccgtttctccccctcttctttccaccccactctgagggcttcttgtgatgagatctaaaagctgtcttacttacaattgcttatactgtcttttgcccacaaagggaggagactgtgcacaatcatggagggcagtggcaagtctggtggagagggaaggaggtcaggaaataaacgagagaggaaaattaagaggtaaggatgtgatagagggaagtattgaaagaaagctcagggagagtgaaaaggaaggaaaaggggagagagaggaggtaaaagtgaaggaaagaggttgagtgcagtggttattcctgtaatcccagtactttgggaggctgaggcaggtggatgacttgaggccaggagttcaagaccagccagggcaacatgacaaaaccccatctctacaaaaatacaaaaattagcgggacatggtggtgtatgcctgtagtcccagctactagggaggctgaggtgggaggatcacttgagcccaggaggtcgaggctgcagtgagccatgatggcaccattgcactctagcctgggtgacaaagtgagatcctgtctcaaaaaaaaaaaaaaaaagaaagaaaaagagtggaatgaaatggagaataaggaaggtacaaatgggagagaaaaacaggaaaagaaaccatgggagaaaaccagagcctgggcaaacgaacatgcaagtggagacatagtgttttctaggacaacaaaacactttagtttggctagagctaagagtgtggtaggtagacaaaattagaatcagattgtagaaggtcttggatgccaggttaatgattttgaactttatattttttattttcctttgttcaaatcccctgtgataagttgttttattttgtttagagtgggtatcaggcagatttctgggtgaggcccagaggagcatttttattcatccatccattcaacaagggactatgtcttatccaacttgtatccctagagtataacacaacatctgcatataagacagaaagtaagtgcttgttaaaattaagcattttggccgggtgtgatggcacacatgtgtaatcccagcactttgggaggccgaggtgggtggatcacctgaggtcaggagttcaagaccagcctggccaacatggcgaaaccatgtctccactaaaaatacaaaaattagctgggcatggtggcatgctctggtaatcctagctactagagaggctgaggcaggagacttgctagaatccaggaggcggagatgcagtgagccaacattgcgccactgtactccagcctggacaagagagtgagactaggtctcaaagaaaaaaaaaaaattgagcatttggagaaagcagtagttgagacagtctcacagagaatataagaataatcatattaaaaggtaaaaagtgctaggtgcccagagagaggcccagaaaagggagatcagaggagaatgagacagccttccctgctacctttagcagaaaagtcccaaagaatattataatggggccatcttggctacttgaattaatccttgtggcctgaaagatacattctgttggagggtatagggttctgtctatcttctgagtgaagggcaaagagttctccgaagaaaagggagggattattactggaagaagggaaattagaactggcatgtctgccaggtctgctgtagtggaacaaggtgaggcacatatagggaacagtgagaaggattaggagctcttcaagagtggtaacagttaaaaatagagctacaggccaggtgcagtggctcacgcctataatcccagcactttgggaggctgaggtgggagaattgcttgagcccaggagtttaagaccaacctgggcaacacagtgaaaacccgtctctacacaaaataaaaaattagccaggcgtggctgggcgtggtgactcactcctgtaatcccagcactttgggaggccaaggtgggtggatcacctgaagtcgggagtttgagaccagcctgattaacatggtgaaaccctgtctctactgaaaacaaaaaattagccagacgtggtggcatatgcctgtaatcccagctacttgggaggctgaggcaggagaattgcttgaacctgggaggcagaggttgcagtgagcgagactgcaccattgcactctagcctgggcaacaagggcgaaactctgtctccaaaataaataaataaataaaaagaaagagagagagagaggtgcaccatggagggcctcaaataccaagttgtggagtttgaacttgtctcttgaactgagagtgcgcttgttgaagttgtgctttgggagtactaatcaggccaccaaggtatggaatggactggaggcgagaagaccaggactgatgggaaattgttctggcatgtcctctggtaaagcctaagcatgagatccttcacccacatcaatgtgttttccgttgtaacttggtttggtttttttgttgttgttcttcttcccattctaggtcagtggattcaaaacgatgaaagtggattcaaaacctctgtcaaggggtgctgtcctttcctggccaagtctcttttattctcttagggctgcaacctcttcacctgggaaatgaatggtcctgtgatttacaagagcaggtaagcacctgcaaagggctttgaagattgatgggcagagtttccagctcaatttctggggagtggcagtatcagcagcaccccgtccctggctctgacataacgatgggagaagcagctccaaggcatcctgctttttttttttttttgagacagagtctcgttctgttgcccaggctggagtgcagtggcacgatctcagctcactgcaacctccgcctcccgggttcaagcaattctcctgcctcagcctcctgagtagctgggattacaggtgtgtgccaccatacctggctaatttttgtatgtttagtagagatggggtttcactatgttggtcaggctgatctcgaactcctgacctcgtgatcctccctcctcagcctcccaaagtgatgggattacaggtgtgagcccctgcgcccagctggcatcctgcttttgagcaggaggtggcccaggccgtagcccagagtcaactctctcctcttcccaaatatctccacaaaggaaaactctgtagcatagcctaagagggagcataagactttgaagtcagacatcccaggccttggtcctcagttgtgcttcttcctagctctggtattttgaataagttatgtaagttacctgagcctatttccttgtatataaaatgggggttgcaatactaatttcctgggctcgtgagagtagagtaagctaaagctaaaaaagcacttggcacagtgccatacaagccacaggcactcggccagtgtgaattcctattcattttttaagaaacagagtcatgtactgttagaggtagagaggtgttagatattcctggtccaatcctctcattctacagtggtaaaaggactcccaggaaggtttcctcttaaccaatctaattctcttctgtcacaatatctgctgattctgtcctcaactagaagcagagaactgagctccaccttctatgcttagctacataaatccgatgggagttctatacctgttcaaaaaagggtattttggttcctccatttttccccccaagaacatttgcctatcatttgctctttgctctgctaaaggtgaagacaattagtgtcccatactcaaagtgatcacgaatatgtgggaagatcatgagcaacacagtatagatgaatcctaagtaaatccagcaatcttggaatatctgaaggaatttgctcccaattattcttagataagctaagaaatgaatacaactgttagttatcgtgtttgtgtttttgtttttactctgcttaattttttaacatttttatttatttctataattatagaaatggggggggggggtctcactatgctgcccaggcaggtctctaactcctgggatcaaatgatcctcttgccttgacctcccaaagtgctgggattacaggtgtgagccactgtgcccagcttctgcttaatttttatttcccagttggcaggggctccctaattctttagctttacttttttatggataaaatatacatagcataaaatttatcattttaactattttttgacagataaacagtttctttattcctcctcatcctcctcctcttcttcatcttcctcttccaccttttcctgggcaactttagcaggaccatttgcaccatcaaactttccttttgccttatagtcagaaacatccttctcatacttcttcagctttgccgccttagtgaagtaaggctgcttttcactgtcatttaagctattccacatttcacccaacttttttttttcttttgccacgtctccaatagagatgccagggtttgtggatttgatctcggggcagaattctgaacagaacaggaagaatccagacagtagccttttggggcattaggatccttcttgttgcctcctttagctggtccataatccttcatttcccgatcatagtgtactttatccgcctttgccatttcattgaatttagacttctctttcccagacatggtcttctacctctcggagcacttcctggaatattctgcaaaattgacaaggacctctgggtttttcttcttatgttcttctctgcacatctgcacaaagaaggcataagcagacatctttccctttggtttcttggtgtcacctttagccatcctgactgaatttcttcttccttcccggccgcctagcaggagggaaggcggaggggagtgaagggcgtggggaggagagggagggccctgggaggcgaagcagcaggaggcggcgacgtggcccgaaagttctgcaggcgctgcggtggcggccccattttaactttttttttattttttattttttgagagggagtctcgctctgttacccaggctggagtgcagtagcgcgatctcggctcactgcaagctctgcctcctgggttcacgccattcttctgcctcagcctcccgagtagctgggactacaggcacccgccaccacgcccggctaattttttgtatttttcgtagagacggggtttcactgtgctagccaagatggtctcaatctcctgacctcgtgatccgcctgcctcggcctcccaaagtgctgggattacaggtgtgagctaccacacccggcaaacttaaaaaaaattttttttttgagacagagcctccctctgtcgccaggctggagtgcagtggtgcgatctcggctcaccacaacctccgcctcccggtttcaagcgattctcctgcctcagcctcccgagtagctgggattacaggcacgggccaccacgcccagctaatttttgtatttttagtacagacggggtttcgccatgttggacaggctggtctcgaactcccgatctcaggtaatctgccagccttggcctcccaaagtgctgggattacagacgtaagccaccacacctcacccattttaactatttttaagtatacaattcagtgacattaagttcattcacaaagtagtgtaatcatcaccacttcctatttccagaactttttcatcatcccaaacagacactctgtacccattaaacaacattccccattttccccttccctcagcctctggtaacctctatttattttaatttctgtctctacgaatttacctattctagatacttcatatgagtggaatcatacaacgtttgtatttatttttgtttgtttgtttgagacagagtacagtgttgggatcatagctcactgcagcctcaacctcccaggcacaagtgatcctcccacctcagcctcctgggtagctaggactacaggcacacaccaccacacctggctaatatttaaaaattttttgtagagacggtgaaacaggaaccctcgaagggtgtgcaatgggggtgtggcttgcttcttcagtgccctgctgctcaaacctctaggggagcatacagatgggcaggctgtggggctccgaccccacagcagtgtctaggggtgaatgtttacagctgaagccccaatgggcgtgtgttatagggtgctcttttaggttgccatctataggcggcttgtgttaaccagctcaattaaacccccttccttaccacaaggacagagggatttctgtatcctggggtttcttgccttgttgtacctggaagaactggatcacatgtgggcttggagaatgagtgcaaggttttattgagtagaactagctctcagcagatgggggagttggggagccagaagggaaatggttttcccctggaaatgttctcatcatgttcaccaacatggtgaaaccctgtctctactaaaaatatttttaaaattagctgggcatggtggtgtgcgcctgtaatcccagctactcaggaggctgaggcaggagaatcacttgaaccggggaggcagaggttgcagtgagcagaaatcgagccactgcactccagcctgagtgacaaagcaagactccgtttcaaaaaaaaatgttagtaaggatgtgaagaaagtgaaccttcatatattgctgggggactgtcaaatagtatcgctgctttgaagttcttcaaaaagtaaaacagagttaccacatgacccagcaattccactgctaggcgtatatccaagagaaatgaaaatgtatgttcataggcggggcacagtggctcacgcctgtaatcccagcactttgggaagccaaggtgggcagatcactagaggtcaggagttcgagaccagcctggccaacaagatgaaaccccgtctgtactaaaaatacaaaaattagctgggcgtggtgtcaggcacctgtaagcccagctactcgggaggctgaggcaggagaatcatttgaaccagggagatggaggttgcagtgagcagagatcacgccactgcactttagcctgggcgacagagtgagacactgtctcaaaacaaacaaacaaaaacacaaaaaacaaaacaaaacaaaaatggaggctgggcatggtagctcatgcctgtaatcctagcactttgagaggccgaagtggtcggatcacctgaggtcaggagtttgagaccagcctgaccaacatggagaaaccccatctctactaaaaatataaaattagctgggcatggtggcacatgcatgtaatcccagctactcgggaggctgaggcaggagaatcacttaaacctgggaggcagaggttgcggtgagctgagatctcgccattgcactccagcctgggcaacaagagcaaaactccgtctcaaaaaaaaaaaaaaaaaaaaaaaaaaaagggaggtggggggcactggctgtggtggctcacgcctgtattcccagcattttgagagaccgaggtgggtggatcacctgaggtcaggagtttgagaccagcctggccaacatggtgaaaccccatctctactaaaaatacaaaaaaattagccaggagtgttggtgcatgcctcccagctactcgggaggctgaggcagaagaatcacttgaactcgggaggcagagcttgcagtgagctgagatgtgagccgagattgcaccactgcactccagcctgggtgactgaatgagacttcgtctcaaaaaaaaaagaaagaaaatgtacgttcacacaaaaacttgtacacaatgtttatcgtgttattatttcttatagccagcaggtagaaacaacccagatgtccatccactgacgaatagctaaacaaaatgtggtatatccatacagtggactattattcagccataaaaaggaataacactgattcacactacaacatggatgaaccttgaaaatcttacgctaaatgagggaaaccaatcacaaaataacatatattgtatgatccatttatatgaataaatcaagacagaaagtagattagtggttgccaagggatagtaggaagttgggaatggggaataacggttaatagtgtgactgcccagtgtgctcaccttgcccactgccaagacagagccgatttatcaagacagagaaattgcaatagagaaagagtaattcatgcagagccggctgtgcgggataccagagttttataattactcaaatcagtctccccaagcattcggggagcagaatttttaaggacgacttggtgggttgggggaagccagtgagccaggagtgctgaatggtcagggatgaaatcacagggagtcgaagctgtcttcttgagctgagtcacttcctggatgggggtcacgagatcagatgagccagtttatcaatctgggtggtgccagctgatccatcaagtgcaggtctgcaaaatatctcaagcattgatcttaggagcagtttagagagggtcagaatcttgtagcctccagctgcatgactcctaaaccttaatttctaatcttatggctaatattagtcctacgaaggcaatctagtctccaggcaagaaagaggtctgcttttggaaagggctgttatcgtctttgttttaaactataaactacgtccaggcacggtggctcatgcctgtaatcccagcactttgggaggctgaggcaggtggatcacttgaggtcaggagtttgagaccagcctggccaacatggtgaaatgctgcctctaccaaaaatacaaaaattaaccgggtgtggtggtgggcacctgtaatcccagctattcaggaggctgaggcagaagaatcgcttgaacccaggaggtggaggttgcagtgagccgaggtcatgccattgaaccccagcctgggtgacagagtgagactccgtatcaaaacaaaaacaaaaaaaacctataaaaactataaactaagtttctcccaaagttagttcagtctatgcctaggaatgaacaaggacagcttggaggttagaagcatgtagagtcgattaagttagatctctttcactgtctcagtcataattttgcaaaggcagtttcaataggcatgggatttctttttgggggtgatgaaatgttctggaattagagagtggtgatggtttcacaactttgtggatatactaaaaaccaactaaattgcacactttaaaatgattaattttatatgttaattatatctcaagaaaaagtacagtatatgatagtaggcacccatgtacatactacctaattccagaaaaaaactgttacaaataccattgcaatttcctatgtactgttcttccatcccattcccctccctctctacccagaagtggccactaccgtgaagttggtgtttatcatggcaattgtcttcatttatttgggctgctatcacgaaatactttagactgagtatcttatacgcaacagaaacttatttttcacagttctggaggttgggaaggccaagatcaatggggtgagggcctactttctcacagacttcacgtttttacggtgacctcacatggtggaagggaccagctagctctcttaggtctcttttataagggcagtaatcccattcatgagggtacccaatcatctcctaaaggcctcatcttctaacactgtcacatttgggattacgtttcaatgtatgactcttggggacacacaaacattcagagcatagcagtaatacatgtctttataacttttaacaaatgtatgagtatccctaaacaatatatagcattgctttgtatgtttttaagcttaatatacatcacataagttgcatcctctgcaatattcttttttcctaccaacattatgtttttgagaattatccatattcttttttttttttttttgagacagagtctggctctgtcgcccaggctagagtgcagggtgtgatctcggctcactgcaacctctgcctccagggatcaagtgattctcctgcctcagcctcccgagcagctgcgattacaggtgcccaccaccacacccagctaatttttgtatttttttgtagagacagagtttcaccatgttgttcaggctggtctccaactcccgacctcaagtgatctgcctgccttggcctcccaaagtcctgggattacaggtgtgagccactgtgcccggtgaattatccatattcctaccactcactgctgtgtagtatttcattatatgactacactataatttattttgtatatttacctattggtggacatttagactgtttctaatttttcaatatttcaaacaatgcttcagagaacatctccaacaggtttccttttgtgcatgttcatttccctgggttttatattcaggagtaggattgccgagtcaaaggcctgcacatcttctacttcgttagctattgccacaagtccattactagtcaggtggagcgttttcatatgtttattggccatttgtatttcttcagtggcttaatgttcacatcctttgtccatttacctaatataaatttgttagtaattctttacatattttcgaattctcatcctttgccagccaaaacattgcagagattttctcccatttagtagtttgtctttttccctttatgacatcttttgatgcacagaatttctacatttaatctggctgaccatatcaagttttttcatttttgatttgtatgatgattaattttatgtgtcaatttgactgggtcatggcatgcccagatatttggttaaacattattctgggtgtgtctgtgagggtgtttgtagatgagattaacttttgaatctgtagactgagtaaagcagattgcccttcccaagtgggtgggcctcattcaatccattgaaggcctgaacagaacaaaaaggtggagtaagagaattctttctccctgtctcactgtgctcatgctggtacttttgtcgtctcctgcctttggacttttttttgagacaggttctcgctgtcacacacgttggagtgcagtggtgggataccggctcactgcaacctccgcctcctgggttaaagcaattctcttgcctcagcctcccgagttgctgggattatagactcctgccaccacacccagctaatttttttgtatttttagtagagatgggatttcactatgttggccaggctggtctcgaactcctgacctcaagtgatctgcctgccttggcctctcaaagtgctaggattataggcatgaaccactgcacccggcctgtctttggacttttatctggaccattggctctcttggttctcaggcctttggactcagactagaactaaaccattggctctcctgtgtctccagcttgctgactacaaatcttagggcttagcttctataaccacatgacctaattttttataatactctctctctattctattggttctgtcagaggcgtttgaaccagagcaactccatcttgagtaggtgctaggtaaaataaggctaagacctgctgggctgcattcctagctggttaggcattctaagttacaggatgagataggagggcacaagatacaggtcataaagaccttgctgataaaacaggttgcagtaaagaagccggctaaaacccaggaaaaccaagatagcgacaagagtgacctctggtcgtcctcactgctacactcccaccagcaccatgacagtttacaaatgtcatggcaatgtcaggaagttaccctatatggtctaaaaggggaggcatgagtaaaccacccattgtttagcatataatcaagaaataaccataaaaatgggcaacaagcagccctgggggttgctctgtctaaggagtagctattattttattcctctactttcttaataaacttgctttcactgggcatggtggtttatgcctgtaatcccaacactttgggaggccgaggcgggtgacctgaggtcaggagttcaagaccagcctggccaacatggtgaaaccccgtctctactaaaaattcaaaaattagccaggcatggtggtgggtgcctgtaatcccagctacttgggaggctgaggcaggagaattgcttgagcctgggaggcagaggttgcagtgagctgagatcgcgccactgcactccagcctgggcgacagagtctccattccccccatccccccaactccaaaaacaaacaaacaaaaacacaacttgctttcactttaccctatggacttgccctgaattctttcttgtgcaacatccaagaaccctctcttagggtctggatccagacccctttccagtaacacttctgtttttctggagaactcagagtaatacaatttgtgactgcgtcttgttaaggaactatttccctaccctgaggtcctgaagatgattttctttagtttctaaagatcataaagttttgcttttcaaattcaggtctttaatctaaccgggggttattttaatgtatgctacaaggtaggaagccattttattttttttccaaatgattaacaagttgttcagtgttattttaaaacaatccatctgtattagtttcccagagctgtcataacaaattaccacaagctgggtggcttaaaacaacagaaatttattttctcacagttcagaaggccagaagtctgaaattaaggtgtcagcagcactggttccttctgaagattctgagggagaaaacctcccatgcctctctcttagcctctggcggttgccagcaatccttggcttgtggacacatcactaatctttctctccatcttcacatcgttttatattctgtttccctgtgtcttctcctcttcttataacgacaccagtcattggatttagggcccaccctaaatccaggatgagttattcttaaaatcttgagctaattacatctggaaagaccccatttccaaataagttaatattctgaggttctgaggggacatgaattttgcggggtacactattcagcccactatatagcatcatcttttgctactcttttgcaaattctatttctgttgtttatccagtgtccatttatgtgtgggcagagtggtcattttataatataaatctctgatgaaatggttagacatttttcatgagataatcttatttaatcctcacagcagtgccgtgaggtagatgctactaaaatcacctactgttgagaggtgtgccagtcagcatttgctaagtatgacgtgataacaaacaaccccaaactctcagtgacttacaaaaagccaattgctttcttcatcacattacacatcacagctgtagattcactgcagctttgctctgtgtcttttcattccagggtccaggctgaaggtgcaggccctatccaagacacaacatttccagtggcagagataaaaaagtaagatttcagactcaaacatgcaatggcactccaagtttctgcttcgaactggcatgtatctctctagctcacatttcattggccaaaggaagtcatgtggttaagcttgacaatgggctggggaagtgcactccttcctctggaaggtacacaagtcacatggcaactggctaggatggataattctcttactggccaagggaagggcaaataatggagaaaaataatacgtcaaccacaggggttgagtaactttcccaagatcaaaccactgggaagggacagaggcagattcaaactcagacagtctccaaagccatagtgaactccatggctccctactgcctgttagatggaatccaaatatatttaagctttagggcattcctgcagcctggagggcccttctacctaatttgtgtgctgaattcactctttaaggctccactccaatctcaactccttggactcactcttatttgtcatgtgttccctctgctctaaggcccttgtacagtgttcccaaatgtttgcagtattttgggatgaaaggagtgaggggcacaagctgcaagtggactgtgctcctgaggatgagagcactttgcctacttttccacccctctaaactaagcttagtatcttgtgcttgggtgactctgacaggtcagccccgcatgactcactctgtaagccttcagcgcgggtcaccacaaggtcctggtttagggtgtgtgagttggtgggtggggaggggaggtggaaattaactttcacctttcaggaacctttcccttccccaggagaaggacaagtgtaagtccttcccttaagtagtctgggcaagtctctactcatcactcctaggaggactggggaggtcctggaaggtgcagaggaggaagctctgagaagtagaaacagcaccaaactgcaccatagaagactttactaatttgtccaaatgacagaatttaccttctctgagcttcagtttccccagctataaagtggcaacaacactgatcttgccctcctccctaagttgctacaaaaagacatagtaaaaatctttagggtgccgggcagggtggctcacggctgtaatctcagcactttgggaggctgaggcaggcagatcacctgaggttaagagttcgagaccagcctggccaacatggtgaaaccccatctctactaaaaatacaaaaattagccaggcatggtggcaggcacctgtaatcccagctacttgggaggctgagacatgagaatcgcttgaacccgggagatggaggttgcagtgggcaaagatagtgctactgcactccagccagggtgatggagcaagactccatttcaaaaaaaaaaaaaaaaaaaaatctttaagaatgcagccttgaaatcgcacagacttgtactggaatccttctcataagctatgtgactgagaaagttatagatcttcataagccattacagctacctcccagggtgagaaaattatgtaaataaatttcctaacatatactaagtactcaataatgttggctattcctatatgagatgatgaaacttattattatatagggaaagtcccagacgaggacccatttttgaacattgaaaggagggagtacagaggctaacttttcttagaattggttgcttcttttagccaagtataaggtgtggctcaaaggaatgaggaagcagttaatgaggtgacagggcacagaatactgtttgtcttcacagatcttgggggagggatacagtggttagctgaccttcccaaaagatcagagatcctggtgtcttgtccacccacagatgcaggccacttgactctgtcctgtcccctcctaccagtccagtcaccacgttctggtgaggctgcctttgaaataataataacaatggtacttgtactaatgatattattactttgaagtgtatgaaggctttctaatacatcatcccagttatccttcattatctctctcccattcacagaatccagagttaggaaggatattgcagatcattctgcattttacagatgggatctctgaaatttgaataaaggaagggatctactcaagggctgggatttacctgagactacacaataagttaatggcaggggcaggactagaacctgcagctcctgactaccagcctagtgccagtgcctctttcaagtcacacttgcattggctttccattcccatggcctcccagtctattctttttttttgttttttgttttgttttgttttgttttgagacgagtttcgctctgtcgcccaggctggagtgcagtggtgtgatctcggctcactgcaacctccgcctcccgggttcaagcaattctctgcctcagcctcccaagtggctgggattacaggcacccaccaccatgcctggctaatttttttgtatttttagtagagacagggtttcaccatgtttgccaggctggtcttgaactcctgaccttgtgatccaccctcctcggcctcccaaagtgctgggattacaggcatgaatcaccgtgcccagccccagtctattcttttatctcctggaccactgcagtggtttcctactggtcctgcctgcctctgatccctccccacccatttcttctacacatacagtcacataattgtctggaagcacagctttgatcttgtctttcccttcctaatagaacttgcccattttttcaacttgagaggtcaccaggatcctagttcaatttcccaatgaagacttaatctttccttgaatacatatattgacaaggagttcatcactcccaaggtggtccattccattcttgggtagctccaactgttagggagttctttatagtgagctgaaattgtcttcctggatatccccccactggaggtgatgtgatggaattctcttttttttttttttttttttgagaccgagtctcactgtgttgcccaggctagagtgcagtggtacaatctcagctcactgcaacctccgcctcccaggttcagcaattctcatgtctcagcctcccgagtagctgggacttacaggcatgagccaccaagcctggctaatttttttgtgttgttagtagagacagggtttcaccatgctggccaggttggtctcaaactcctggcctcaggtgatctgcctgcctcggcctcccaaagtgctgggattacaggtgtgagccatcacacttggcccctttttgtttttttttttttttagacagagtttcactcttgctgcctaggctggagcgcagtggtgtgatcttggctcactgcaacctccacctcccagattcaagacattcagcctcccaaatagttgggattacaggcatgtgccaccacgcccagctaattttgtattttagtagagacggggtttcaccatgttggcgaggctggtctcgaactcctgacctcaggtgatccacctgctcgaccttccaaagtgttgggattacaggcgtgagccacagcacctggccaatggaattctttcgtatccattctggcagcaaatctgtagtcattgtttcataggaaccaggtcctggatggactaggtgctgaggagaacagcatataaatttgatatggatccttccctcagagagggtggcctaggagtttgctaatgcagaattttttgttttgttgattagacctaaacgaaaggaaacaaagcaaatcctctttctgtatgatagtccttcagaggtgtggagatagtcaccatgtctactctgtgctttcccttctccaagctatttaaatcattcatcatacagcatggcgtccaggtcctctacgttccggtctcctgtagacatgctccagtccccctaagaatatggggctcacaaatgagcttggtggtccagctgtgatccatctagggcagagctggcccaacttttttttttttttttttgagacggggtctcactcttgttgtccatgctggagtgccgtggtgtgattttggctcactgcaacctccgcctcctggattcaagggattctcctgcctcagccgcccgagtagctgggattacaggagtgcgccaccacgcctggctaattttgtattttttttttttgagacagagtctcaccctgttgcccaggctggaatgcaatggcacgatctcggctcactgcaacctccacctcctgggttcaaccagttctcctgcctcagcctcctgagtagctgggattaaaggcacgtgccaccacaactggctattttttttttttttttttttgtatctttagtagagacagggattcaccatattggccagattggtctcgaagtcctgacctcgtgatccgcctgcctcggcctcccaaagtgctgggattacaggtgtgagccactgtgcccggtcaattttgtatttttagtagagacagggtttcaccatgttggccatgctgatctcaaactcctgacctcaggtgatctgcccgcctgcctcggcctcccaaagtgcttggattacaggcatgagacactgcgcctggcctcaactctggtttccgttgatagaatattcatattcactttctcctccttcctttcttcgctttctccttcctccttctctttgttccctcctccctccctccctccctctctctcttctttactccttttctcccttcctttctttctttttggcagcacgttgcattgttgagcttgaggtcaactaaaacctttaagtcactttcactgtaattactgttgattgagattctttctacactgtatttggggcacttgctcatttggaagggcactgtccaatatggcagccattgtggccattcaaatttaaagtacttaaaattaaatacaattattattttgcatttcctcagttggactagccacgcttcaagtgctcaatagccacagagggctagtagccactgtatcagacagcaaagattcaggacatttccatcatcatggaaagttctgtgggactgctctggtttggacctaagagcaggagtttatacttacaatctgaggcacgtcatcttgagagttccagctcagcctccaaaactgctgagagctttaagaaactgattctggtttccggagtcttcattttccctcccaacctcatgacaacagtagatttgatcaacgtttcataccttcctctgcttcatctaaaaccaactgataaaaatacccagcagaacagagaggcttgcaatcgagccctctatgtgacaccctgctctccagtcccatgcggcagttgtgcagtcatttaacaaattaggcctatatcctaggtgctgtgctgggtaccaggtacctacaaggaagtcagaagacatcaattaaaaaaaaaaaagagtcctgctgagttgggtgctctagtagttcaaatgtctttgcttcccattcaaggctgcctcttctgtctgttttgtggttgttaaaagtggaagcttggggctgggcacggtggcacacacctgtaatcccagtgctttgggaggccgaggcaggcggatcacttgagtccaagagtttgagaccagcctggccaacatggtgaaaccctgtctgtactaaaaatacaaaaattagctggatgtggtggcatacacctgtaatcccagctactcaggaggctgaggcaggagaatcacttgaacccaggaggtggaggttgcagtgagccaagatcgtaccactgcactacagcctgggtgacagagtgaaagtctctctcaaaaagaaaaaaaaaaaaaacggaagcttgggagtcagcttcccaagtttggatcctagctctgccactttagaagctatgtgatgtctttgtgtttctgtttcagcatgcataatgtgggaataagaataacctctaatgttattgtgagaattaaacgaattaatgcaaataaagatcttagaacaataaatatagtaagtgttcctaaccggtgagttattatcagttcttattgttaatcataatcttccttcctggacaagccatgttcagtcctgctttggggcctcagttccttagttttgccctcccttagtttgtgtaagtccttggaggcccaagccctgcctctccttcctgctttcttatgttctcagctgctcactttgcacctgctcttagtatcctatacctgaggcatggaccacagtgaagaaccagaattgttgggcttcatcttggctctgtgctgcctggaggggagacctaggataggctcctgatctgcaaaatggggataatcccagctgccacttaagtgagacaagtaggtgaaagctacttagcaggcctttgcatgtcttgacttccagtaaaaccctggcaagtgaatgacatttgcatcttccctgtttcttcctttagcatctaacaaaggaggctcaggctcattattccgggcacttctggagggcctggccctgccccaggagccctagggcaggaattcctttctttatctatagaaggcagacacttcatccctgccccatcttctttcagatgctatcttgggctcgctgaacacgggttagttcctcctctctcctagcctcagtgtgtactccaagaaggacctaaaggagcgcctatacgggccgtggtggttataaccctaatttagaaaagcccattactttgggggtgtttgggcttgtggagggtgggcgtcgggatcccagagccagggactcagcccttggagagtccccagagagtccagaggttgccacctgcgaggggctggaacgcactgggctatcctccgcgagccctggccgcgggaacaatgggagcgcggcgtggaaaagggtgggcgtgggccaggtcctggctggaggtagacgaggtcggcgagctgggcgcggggccgcggggttaccccggggcaccgggcacagagccgagaagtctaagctagggaaaatcgaggtcggcgctggcgggaacccgggaggacgtgggggccccgggtggggtctgctcctcttcttcgcccggcctctgagcccgccgcagctcaggttgacgccgggcccacgtggggaagccggcggcgggtccccagcgccgggagggttcgcggggctcagccccttcctctgctcccctccccgggaccggcgcgcggccccagctccggcggctccggcggctccggcgctcccctggtgttggctgctcgccgccgctgcttgctcgttcgcccgcccgctgctgcttggggggccgggatcgccgccgcctcctccgggggagccggccggggcggggcggagcggcgagagggggtgtggggggcgggcgaggagggggctgagcgccgtgggagggagagcaggagcgagcgcgcgagagagcggggcatttctgcgcagctctagcgcgcctcggagcccgccggggcagccgccggacaccaggaccgcgagccagacagctcccggaagccgcgccgccgccgccaggttagccgcacccgccgtccccctccgcgtcccggggaccccgccgcgtcgggtcccgcgtgtgcgtgtggggtggccgccgagggcggcgggctcgattcccgatctttgggcactgacaggccggcgggccggctccaggagccgcgggcttcggttcgtgtgtgtggggactgtcgcgggtttgtgtgtcggggctccagtctctgggtgtgtgttaggtgtgagcgcgcgtgtgcccgtggatccgtgcgagcggctgctcggtgtgcgcgcgcgtgcgtgtgtgcgccgggtgtgcatctgtgtgtgcgtgtgtgagggtgtgtgccttgcgtgtcttcgcgagtggtgcgtgcgtatctgggtgagggtgcgtgtgtctgcgtgtgtctgtcggtgaatgtatctgtgagagggtgtgtccgaatgtgtagcagtgtgtacacctctgggtgagggcgtgtgccagtggcttcgcttgtggctgcagcctgtggcgggtgtgggtgtgtgtgtgcgcgcgcgtcgctgtgtgcgcgccagtgtaactcccgtgtgtgcgcgtgtgagtgcgggtgtgctcccgcgtagcccccgtgtgcgtgtgcgcggctttgtcttcgcactgccgggaggaagcggtgggggcggcggtccaggcgccgccgccgctgggagctgggcacctggcctgggcggtgggtggcggcggcgggggtgtcccttccccgtcgggcagagactccctgctggcaggtgggcggccacaccccgggggtcgggggaactgggctgacagcagagcccgcgttctgacctgagctggagaggagggcgtgtcctgcttgaagcccgtgtgcgtgcgtgcgtgcgtgtgtgtgtgtgtgtatgtgtatgcgtgcgcgcgcgtgtgtggatgtgggtgtgggtgcggggtggtggtggtagcaacagcagtttccaggctggtgaccagccggttcagggattcatttcctgttgtggccaggggacatgtcccctccggcctccccccagccccccaccagacctagcctgtgccagtctcacccgtgcagggctctgggtgggtgggaaggtaggtgggtagaagctcaggtgccctgaaaaggactaggagggagaaccactctcttaaagggccagctcctcactccagggaatccctcctcaggagacctctctactttgaaagagatgtctctgggtatgtccatacccctttctccaagtactggtgcatacaggcatttctagatctgtagtctgtgtgcatgtgtcctccctgtgtacttcttgtacatttgggtgtatagtgaacagtgaaaatgtatctcttgatgtatatgtgtgtgtgtttttataggttctggtatatttgtttttatgtatgtgtagttgtttgtatattagtctgtgcatgtgggtttgcagagaagtggcattttgctgccaaatggaatagaagagaaacattctgtaccgggccacgccatttttgaaaaactgcgtgaaaaggaagtttgggaatttagtctgtggctttgtgggtttcagataccggtactgaaatgtaggtaggttggattttgactgtgatacaagggtagagagaagtagagtcttataggaggaagaaattgttcagagagaaggatatccaagtgcaagaattcttccattagttccagttcttccccgtaacgtcacatccccctttgctgcttggcttgccaagatacaggacacaggatttggagtgcaaagggagggagctgggagtgtaaaaggaaggaaggtggatgggtgataggattgggggccagcagcagatttctgcaattcttaaaaatgtttccctgccaaaagcagcagaggctggggaaagctgagctttctgtcccctccttgaatcccagaatcccgggacatgggaaaagctggcctggagttcatgagctctggagtctgggccagagatcttttgccttgttctgtcaccgagactggagtgtaggcagtgtcacgatctcagctcactgcagcctccgcctcctgggttcaagtgattctcccgcctcagcctcctcaatagctgggactataggaatgagccaccacgcccagctaatttttttttttttcttttttgagacagagtttcactcttgtcgcctaggctggagtgcaatggcatgatctcggctcactgcaacctcctcctcctgggttcaagcaattcttcttcctcagcctcccaagtagctgggattacaggcacccaccaccacgcccgactaatttttgtatttttagtagggacagggttttgccatgttggccaagcaggctttgaactcctgacctcaggtgatccacccgcctcggcctcccaaagtgctgggattacaggcatgagccaccgtgctcggcctaatttttgtatttttagtagagacagggtttcaccatgttggtcaggctggtctcaaactcctgacctcaagggatctgcctgcctccgcctcccaaagtgctgggattacaggcatgagccgctgcgcccagcctgggatcttcttttgactttagccaaccccttcatgtgtttatctcttcacccaacactttttattaagcttctttatgtgaaagggtctaaactccctaagccttggtttacctggctaggcagctagtgggctagattttgggactttgatgacccttcccttgctcagattgctagagtttgtctcgttgttacccaggttcaggaatccacccttctagtccccagagatcctggccatggtcctcactactaatctccccaccaatatactctagtctagagctgtggttttttcacctcaccaacagcagcagggttacctgggagtttgttagaaatgcaatttattggcagggcgtggtggctcacgcctgtaatcccagcactttgggaggcgaggcgaatggatcacctgaggtcaggagttcgagagcagcctggccaatatggtaaaaatacaaaatttagccgggcatggtggcacgcgcctgtaatcccagctactaaggaggctgaggcaggagaatcgcttgaacccaggaggcggaggttgcagtgagctgagattgcatcactgcgcaccagcctgggtgacagagcgagactccatctcagggaaaaaaaaaaaaaagaaatgcaatttcttggttctcacgccagacctaggaattgataactctggaggtgtggcccagcaatctatgttttaacaaacacaggtaattcttatttactctggagctcaagagaggtggagacagggagccaggaaacatctattaattgaaacacttggaaagcctcccctgtccctcacacaggtgcctgaaatagcactcaggccccacctggtaggtaggaattctgctttcaagtcccaggtcttatgatcttggacaagtctctccttcagtgactaatgcaatgactctttgacagtgtgctgtggaccaggttctgagcgaggggtttccctgatctgctcagtttctccaattcttactttgatctctaaggcccttcaggatccagttcctgcccacttctctggacaacagccactttggccttttagttcatctaggcaccatgagctcttttgcttctgggattttgcacatcctgttccctttgtctagcacactcttcccctgcttcttatcttgattaactcccactcttcatgtttcagctcaatagtcactttctcaggggggcctttgccaactctctaggccaagtcaattttccctgttacacattcttagagctctctgtgtctcacagggcttgtgagaatttgtaattgttgtttgtccctttactagactgtaaatgccatgtgggcaggaacttgcttactaatcttcttagtgtcccacacagtgcctgacttatgatttgtgttcaataagcttgtcaaactgagttaatttataaaatggcagatggcactaaatgatacccaaagtttcgtttcaagccctgacaatgtgtaatccaagcaggcttcagccttttctcaagttgatttacctgtctttttcaatgctgcatctcccatctcctggctgtagatttgagcactcaccgtgggtccaggcccatgctgggctctgctctagtggaggcaggaggaggctcctcaggagacacagcctagcttgggttctgtgtcttcctggattaggtttgtactggaatgagaagaggaaaagtattgaaagaggaatccaaatatctgcgtccatgccttgttatgtgactgagggccaatcactttccccttttggcacgtgtccatctctgtaaaatgaaggtattgggatgggtggcacacttagtagtggttactagcactggctctacagtcattcggggcttgccatgtactagctggggggactagggcaagtgattccatttcctcatttccttacttgtaaaacaggaccagtactagtatctgtttcacaggattgttttgataattaaatgagataacatccttggaatgcttagcataatgtgagtgcataagaaacatttgataaatgtcaactattatgaccattattgctactccacaattcagctcaacattcttgaaggcctttgtattgggccctaggcctacaaaaacagaaatgaatccagcagtattcacaggttgggggtgggagcagacatgtaaagatgcaataccaccgcaaggacaatgtacaagctgccagggtgtggctgtttatggaggaaaaggcttcctggaggacagagatggtgtttgggctggattttaccgtctgggtatttgaaatagcatgtgcaaaggcagaacggcttcttaggggaaccccaaatagttccacatggttggaataggaggtggtgagtggcagggatgagggtggaggagtgaatgactggagataaagctgagaggaagattagggacagatctggtgcaggccaaagagcctgagcaagtcctgcagacggcagggagctggggaagaggagtaagccaaccaggaaggatcagatttgcatttcaaaaacacagctctccaggtggtgacagaggatggttggtctgggaggaagggaaggactgttgacctggagacctgggcacagaggctgctaaacaagctcaatgggaggccccactggggtggatagatacctagaacaggctgttctaggaagctttttcctctgtaagcctgtcttcagcctggtttcacgacagcctggccctggaaggtgcaggagaggtgagagtgacttctcatgaggagcctctgggtcctctttaacctctaaagctgcctaatgagtgggaatctgaaaaacagagtttgagggtcctaggtctgctactcaaaggatgcacagtgtattaacttcctaggggtgctgtcatgaagcacgcaaaccaggtagctttgaaccacagacatttactcccccacttgtggaggctagaagtctgaaatccaggtgtcagcaaggttggctccttctggaggctctggggcaatctgtttcctgcctttctcctagcttctggtggttgccagcaatctttggcatttcttggcttgcagctgcatctgcctctgtcgtcacgtggctttctctctgtttcatttcctcttctaaggacaccagtcatatgggatttagaacccaccctagtccagtatgacctcatttgaacttgagtaattgcatctgcaaagaccctgtttccaaatatggtcacattatgaagttttaggtagacataaatttgggttgggaggggacactgttcaacccaatacatgcaggaagttggggaggagtgcatgccttttagttccacagggctacatccaaatttaggctttgcagtggagcctctatgaaatggagacagtaggccaggcatggttgctcacgcctgtaatcccagcactttgggaggccgaggtgggcagatcatctgatcagatttgtatttcaaatttgagtgatctgaggcggattattcctgaggtcaggagtttgagaccagcctggccaacatggtgaaacgctgtctctactaaaaatacaaaaattagccaggcgtggtggcgggcacctgtaatcccagctactcgggaggctgagacaggagaattgcttgaacctgggaggcggacattgcagtgagctgagattgtgccactgcactctagcctgggtgacagagcaagactccgtctcgaaaaaacaaaacaaaacaaaacaaagaaatgggacagtagcacctacagtagtgtcatggtcatgagacttgatcaaaataacagatatgagcatgcctaatgaggtagtacacagtaggcactcaatacctacttcctttccagctctcccttctctgcacttaggagcttggacaagtcacctaatcttgctttactttcctcatctatcaaatgtgaataatcatcatccagccctgcctacttcaccaaattgcgatcccaggagataatgagaaagctctttgtaaattgcttaagggcttgtagctgtgatttttaattataataataatcatcataataacccttggccattgtcatatccgctgcattctcctcagagcccagcccagcccagcccgctcctctcctgagacaggtcctctttgcctgtttgtgctcagaggcatcccatgaagtgtcgcctctgtctgagttgggaggaccttagagatggtccttgccgttgcccttattagcctgaggagggaaacatgctcagggagaaaaagtgacacccgcaaagtcacacagctggtcagtggtaattggaacaccttatctgtggctcctgtcttcagtctgaacagtgctttttccctagttgcaactttaggcccagaagcaggagctcagggcagatagaggcctggagtgggctctgcatatgttccagaggtgaggatgcaacaggagagtgtcctgctgtcaggattagaaccccaagaaaggggtccctgggctctgagtgagcaggctgaatgggccggttgttctgttatcactctggctatggccatctctgcctactctggtgggagggccaccatgcggggctctggagtctagatgtaacccaaggcttcagtgtccctgttgacagccagggtggcatttctcagcaggtcctgtccctctaagccttgccttggtgggtctagggaaagctctgggaaagagagagggcttatactgtcctggtagtttctggcaagtcatcttcctttccccccacactggggaagccaggcccctccttggccccttgattcttctttcctttcctccctcctcttctcagtttgctctctcccttctgtctgctttctccccttccctctccccaccttgtccccagattagaggtctaaagatagagtctccaggcccacttcaggtgggtggttttgggtttgcttgaggccacctagaattagaaagtctagagtcttcctcataagaggctcactctggtgacttataatcaactgcttatgtttattggcttactgtgtgccaggccctgtgctaagcgctttacatgccttatgtcttttaatccttacaactaccaagtgaggcagagatgatgatccccgtcgtattacaggaggctaaataacttgcccaaggcctacgcagtcctcagccagcaagtggcacagctgggatttcaatctagatctgtccgaagcccaccggtactcttgagtctttcctatatggcctgtgacagagcctgcgggagcatttaggtgtccacagaggggcatgcatttgctcaaattcagagaacaaattcttgactctgaaagaagggcttccaatcgaggaatcttccctcccaggcctgcactctggcagcacctccgggactggcctttctacagcatcagccttggggcccgccaaggctctgagcccatctggttctaggcagctgcccacctgtaggagagacactgcatcggtatggggggtggcgacagggcccatctgaaggtacttgccttttttcctagttattgttttgtctctggccacctcaatttttcattgaatcgagtcttccacttaaagaagcatatcatttgcaaagagcattacttttgtctcctcacaagactgcttgggagcttggatatgctgcaggctcagtgacgggtggaactctggaagaagtggggagggaggcagagaccggagccaggagacccaggttcagaggtacatatccaccagaagaaaaaaaggagctggcctgagggccagagggaggtggcctggagagagggaggaataggaaacctgctctcaccccatgtgcagcccgggagtccagactccctcccagtcagggctgctggtctcagactgtcactcaggaatctgggcagctgcagtcagcttgttgagcctccacccaccccaaccgagaccattatgttggtcagcctggctcagcccagccacctgcctgcctgagcaggtggctcagtcagaagggaccttggtgaaggagtggtggctttgaaacttctatccacagagccactcttcataggcaagggagcagaagttcaatttgtgaaacacctaaaagggggagcagcttagcaccccaccccattcccctccctcctagggttccctaaggctgggcctctcaaactttgtttccccctaagagcaacaaaggtgagcatgctaaaaagcaaaataaaacaaaacaaaacctgtgtgccatggctcatgcctgtaatcccagcactttgggaggctgaggcaggtggatcacctgaggtcaggggttcgagaccagcctgacatggtgaaaccctgtctctactaaaaatacaaaaattagctgggcatggctgcatgcacctgtaatcccagctactagggaagatgaggcaggagaatcgcttgaacctgggaggcggaggttgcagtgagctgagatcacaccattgcactccagcctgtgtgacagagtgagactctgtctcaaaaaacaaaacaaaacaaaacaaaacaaaacaaaaaaaacaaaaaaacccagcactctttttccagacctcacccaagagattcaaacccagctgctccatgggcggggtggggggtgggcgtcagatccgaggtagggccccggaagcagcctgctgtaacagtctccccatcgagatgattgggacacagatggttctcagattgcccttgtagaaggctggcctcagatgttcatgaacttctgaaatatggcatgcacaatgttaagagtgtgcattgtccctaggagaggatccacaggcaccgtctgtcttggagtcacaacccatacaactttagaactgctgtcttcagggttgttttgcgcagttggagcctaacgtctagagaaaggtcaccagggagccaatggcagagctgggtggagagggctggtctctcatgcctctcagcacattactggctttgctgtgaaggtggtcagggactgtagacctgtccctctgtctgggcctcagttttcctagctgtaaaatgggggttggacaggataatcccaagtttccatgcagctttgatctgtggttctggaagtcaggtctcctgctgcccagtccaagttctttgtccttttccttgctcctccctggcttcacccaccactggggggacctcccacttttgcatcttccatcttcagagattctggacacagcctgcattctggccccttgagtcccttctgtctgaccacatgcccaaatgctcaagtcctttctccctttccgtccccactcaccataattgagcaaggtgcctgtgaatctggggaagctcaaggtgacctctgttcagagctggacatgtgggtcagtgccaaggggagggctgcgaaaactaatttcctgaggctcctgggacacacccagtgcttcctatgtctttgccctagctccctctgttcctccctgccaagaatgccaccccctccattccccaatcactgttgaaatcctgtctgccttttcaaggctcagctcagatgccagcctatgtcctacaaagccttgtaagccctccccctcactccaagatgaaatttgtctttaactcctctgcactcccttagtaccttatctgttcccctctgggggatgagttctttttggtcttagctttatccagggaggtggctttcaccgggttgtgagcactgggatgccttatgtcttattctttgcttcccagcacctagcatggggctgtgcacagaacaagttcttaattgaggcttactaagtttgcagaatctgcctccagctctgggctgagctggcctctttacagcccctatggcccatgtcactggcaggccatggtttctcacagggcccctccctctatttgtggattggagggaggccaagtagggcaataagaacttaaattccgatcttgattctgccatttctgggctgtgtgaccttgagcagatcacttcctctctccgagccttaattttctcagtttaaaacaaagaggtagggatgacaagtctactgggggcttgggtgaattaactgaagtgctttgtgtaaaatgctgataaaagcattgtaaagaacaaatagctaataaatgattatgagttattattttttggttaatagttattaccattgtttctttttctttctttttttttttttttttgagacagagtctcactctgtcgcccaggctggagtgcagtggcgtgatccagctcactacaagctccaccttctgggttcacgccattctcctgcctcagcctcctgagtagctgggactacaggcgcccgccaccatgcctggctaattatttttggatttttagtagagacagggtttcaccgtgttagccaggatggtctcgatctcctgacctcatgatctgcccgcctcggcctcccaaagtgctgggattacaggcgtgagccaccgccccggcattattaccattgtttcaacaaacatctactacgttctgagcattgtgctgcgggggccagggtgagagacaaaaaaataataataacaggagttccttggtctccagggtcttaaggtcaaatgaggcagtaagactctagtacaagaagtcagtgtctggcagagatgtggctgagtgagttgaggggggagtcattagtgtagaggtgacaacaggctagaggtgacatttgagccagaagggcatgaagtaggaagggcaatgacaggctgggaggagacccatattccctgtggagaatggggaagtggggtgcatatttggagagtttcaggaaggaggcgggaaagagcagagcggaagcagagttagaatttccctgcagaaggggcatagggtcggcaccccggatggagcaggaacttcaagctttgttttgccaagaagaatttgggggagtgatgactcatgatgccgccattgagagtaagagagagactgccgggaagatggggtagaaaagtgaggctttatggcagagagagtggggaccagggaggtggggggacattgtccctctctgcccaggcttgtgctaagaatggtggcaagtgggcttcagttccgggcttctgcagggctgcctgtttatctggccaagattgggatttgaacattgatgtctgaagttaaagcatgaaatgactccagaaatgtcagaatctctatatgtcagagcccaccagcagaagtgatctctgaatccacctccctcatgccacgctatgcaggtgggaagcagaggcctgggaggaggagatggcacccaagaacaccgagtgaactggcctcgcgcgctctggatgggctgtgcgcactctggatggacctaggcctgtgttagggtgaggagggggccagggaacccatgaaggatgtacatgacaagcaaacgttaagctgggagcagtctgttgctagggtgtgtgcgtgatcccaggtgagtgggatgtgagtgggccggagccgtcatcattccaggctttccttccggaaaaggagaaagggccacataggtgggaaccaggggaatattgggatgtgggggaaatcagggggtggcttgagaagaggaggctgttgccaagcagcaagagacatgactgtatgagaacagaacaggcaccctagcgtctgtgggcctggcactgtacagccctggactgtagtggtatcacctccattgcaggggaagaaaccagggcttccaaggtcagagctaggaagaatggagtcaggagtggcatccagggctggaggacttcagagccatgtctctggcatgccctgggtggcagccattccagttcttgtgaggtcctggggtcaaaggggtcaaggaggtactcagcccagggcaagtcatcttttgcttcctttcacttcttctccatcaatctgcccattgagcgggcctgttttcttctactttacccaccccccttaatttgttgatgaaaaatatttattgagcacctattatgtgccaggcactgcccttgatttcatggaacttatgccatcgcttcttggcacagagggctatcccacattgccagggagtgatgggaagaaggaggggagggggccactggccacttctctctccctttacatgagcccctccctcttctcagcctctatccccttgcaaatgcccctagccccagatggttcttgttggaactacctcctgctgaaatgaaaaccagtcagagttaattgttaaacctaatagctggtgagagtttcactctcctgggctggtgggaggggggctgcaccccaggggaggggtggagtcacccaggtttttctggctggtacctgccaccttttccctattctggaatctgcttccagggccctctcctcccctcctccccagggggcaggctgccacctggccctttcccctgcctccagctaaggtgaccctgggaggtgagcactggctctggccttagtccaagggcctctgggtgagtgctcttaggggaggtgtgggggagggcagggtgcctagccctggagacccgtccagaggccaggcagccagtggaccttgctggctttgcctcctgctgggtgtgggtgggggaactaaggatggtgccacagtggcctaagccctgcacacaggaccactgcctgtgcagcccatgccatgccgttccgctctccttcccttttgtcctcttcattgagtttcttattctgggccattctctgccaaaagactgggagatttgggcaccctgagaatagtggcaaaggcttattacttctagaaggctgagcctcggggtaggcccctgccaaagtttagggacagagctcagggttccaagtcagcaggcctagtcaaagctgggtgactttgcgcaggtgacttacctctgtgagccacagcctcatcctctgaacactacaggagttcctattttggggaggtttgaggggtcagtgaaggacactgggtactcagatcccattgtcaccatcactgtgtgggcaccagaggtaaatattaattttaggttcagtagggttttgttgaatgagtagataccattctattcagaggtaagctcacagaggtaagtcaactttaccttcgaggcttagctctgggctagggccaaggaggtcatcagcccaggccctcaaggacttgactgcagagctgcagctgccctatacagcagccattagtcacatgtggctagtggacatgtaaaatgtggctagtgccaccaaggaactgaccttttgaactctgtcgcccaggctggagtgcagtggcacaatcattgcaacgtctgcctcccaggctcaagcgattctccttcctcagcctctggaatagttgggattacaggcatgccccaccatgcttggctaattttttgtatttttagtagagatggggtttcgccatgttgtctgggctggtctcaaactcctgagctcaggcaaagtaatcccaaaggatttcaggcatgagccaccaagcccagccaaattttaaattttatttaatatttaattttatttgattttaactaatttaacattttaaaagaatgctcccttcatttattgacaaactatgcgtgtttggaaacttagatttgagaatatacctttttttttttttttttttttgagaaggactctcgctttcgctctgttgcccaggctggagtgcaatggcatgatctcagctcactgcaacctccgtctcccggcttcgagcaattctcctgcctcagcctcctgagtagctgggattacagatgcacaccaccatacccggctaatttttgtatttttagtagagatggggtttcatcatattggtcaggctagtcttgaactcctgacctcatgatccacctgccttggcctcccaaagtgctgggattacaggtgtgagccaccgtgcccggctttttttttttttttttaaatcataaaggcggctgggcatggtgcctcatgcctgtaatcccagccctttgggaggccgaggtgggcagatcacttgacgtcaggagttcgagaccagcctggccagcatgtgaaacccccgtctctactaaaaatacaaaaattagccaggcgtggtgcacgtgcctgtaattccagctactcaggaggctgaggcaggagaattgctggaacctgggaggtggagattgcagtgagctgagatcacaccactgcactctagcctgggcgacagagtgagactccatcttaaaaaaaaaaaaattgtaaaggcaaggagaagctaaatatcttatgaatatttagcatctgaatcaagatgtgttgtaagtataaaatacacactggatttagaagaggatgtattaaaaaatgtaaaatatctctatagtctttttaattttagttttaatttttttttttagaggcaggttctcactctgttgcacaggctggagtgagtggcatgatcatagctcactgcaacccttgaactcctggacttaagagatcctcccacctcagctagtagctgggactttaggaatgtgtcacctcacccagctaaatttttttattttttgtagagacaaggtcttgctatgttggccaggctggtcttgaactcctggtttcaagaggtccttccacctcagcctcccaaagtgtggggattacaggcatgaaccaccgtgctgggcctatagtattttttacattgattacatgttgagatagatatattgggttaaatgaatatattatgaaaattaatttccctcattcctttgtgctttttaaaatgtaggtactaaggccaggcacgatggctcacacctgtaatcccagcactttgggaggctgaggcaggcggatcgcttgagaccaggagttcgagaccagcctgggcaacatggggaaacctgtctctactgaaaatgcaaaaattagccaagcatggaggtgcgcacctgtaaccccagctatttgggaagctgaggcatgagaattgcttgaacctgggaggcagaggctgcagtgagccaagatcgtgccactgcactccagcctgggtgagagaacgagactctgactcaaaaaataaaataaaataaaatgtagctactatacacttttaaattacatatgtggctcgcattgtatttctatttgacaacactattgtagacagagttgagttgggcacatttgattaataacagaagactacataaagactagttatttggggaaggttgggaggtcaatgaaggacagatattccccacctcaccccagcccgggccttgccccttggtggaatgttaccctggacagccccatagccttgaggatgagttcagggcttcttttttttttttttgagatggagtctcgctctgttgcccagactggagtgcagtggtgcgatcttggctcactgcaagctccgcctcctggattcacaccactctctcacctcagcctcccgaatagctgggactacaggcgcctgccaccacgcccggctaattttttttttgtatttttagtagagacggggtttcaccgtgttagccaggatggtctcaatctcctgacgtcatgatccgcctgcctcggcctcccaaagtgctgggattacaggtgtgagccactgcacccggccgagttcagggcttctgatggcaaatgaaaaaccttggtctgggtcctcatcctggccacgcccttcacttgctctgtgtgtgaccttgggcaattctctttgctgaacttgagcctttcatctgcaaactgagactaatggtggttgaggggatggcctgagaaataatccaagtgagtatttagcacagtgcctggcatgcctaagcagtcaagtatttgctgtgtggtgattgctactactgttagtgcgggggctgttgccacgacagtactgttgcatccagcagctcatattcagttattccatgtgcctcaaggggacattggccagaggggaagaagttaaaatagcttgagggtgggagttgggatggggatttggggctgctttgtatgatacctcaagagattgcttggttttcaggtagctccttggatattcctttctgcaagtgatcaggcaaagataaattccattttacagatgaggaagctgaggcctgtgaagggaaagtgacctggctacacagccggaacctgaatgcaggacattctgcccctgtcgtggtggtattggagccagctaatgccaccattcgaggttgcaggagcagcacctgaccagaaatccagagcttgtaagcaatggttattattagtcttctataactggaaaggatcttgacattgtttttttttttttttttcttgagacggagtttcgctcttgttgcccagcctggagtgcaatggcgcaatctcggctcaccgcgacctctgcctcctgggttcaagcgattctcctgccttagcctccctagtagctgggattacagacatatgccaccatgcctggctaattttatatttttagtagagacggggtttctccatgttggtcaggctggtctcgaactccccacctcaggtgatccgcccgcctcggcctcccaaagtgctgggattacaggcataagccaccatgcccggccttgacattgtttagtacaacggtctcattctgaagtcgaagaaacagagatgagagagacagagcaagagggagaaagagagagagaactgctgatcacatagcaagttggtggccaagctggagctgattctgtttgcttagatccaggcttcagctcagccccagcaggatggatggccctgcttgtcagtgcccttctctcctgcccagtccccagagagggcttctgagaaagaggcttttgtttcatcagctcctcctggtttcctctcaaggtagctacacacatgtgcacacacacacacactcacacccattggccccagtttgcatttgttacacacacacactctcacatcccattggcctcagtttgctttacacacacacacacacacacacacacacacacacacacaccattggcctcaatttgcatttgtccctattccaggtttaaaggaccctgaaatttgaagactatccacacatatctactttctggatatccacggagagaccatgggctttttcatcaaggaggcctgagttcaaatccttcttctatgtctgattctctctgtgaccttgggcaagtcacttgttcttttttgacctcaacttcctcatttgaaaagcaggaacgggaatggtatgtgtacaacctagtggtttagctgggctccagaccccagccgcagtgtaggggtctcagctctgccacttattcactgcctggtcttcagtgagtcatttcatccttctaggtctcagtttccccatctttgaatggtgctgctaccttttggacagttgtgataaggcaccttgctgagctgttcacaggcatcatctcatttagtccccccattagccctgggagcagacacttttactcctattttccaaatgaggaagtaaagtgacttgccctgggccacataagtagtaagtgttagaaccagaattcaaacaggtctgagttactccagagcctaagctcataaaccactgtgtgttcttcctgttcacctgagtttcacattttacatgaagtaggaacacctcatcccacctggagactgactgttctgagtgtgtgagtccagggtgcctgtagcttctccctccaagtctcctgccccattgcatactaagcctgacctgtggttggagctcaaagaagattgagaaaagtacttacatactttgagtgaattacaccagaacaggatgtgaatgctaaaaagaccccgagggaggccgggcatggtggctcatgcctgtaatcctagcactttgggaggccgaggtgggtggatcacttgaggtcaggagtttgaaaccagcttggccaacatggtaaaacctcgtctctactaaaaatacaaaaaattagccgggcgttgtggcgcacgcctgtaatcccagctacttgggagactgagataggagaatcgtttgaacctgggatgcggaggttgcagtgagcagagatcgcaccattgcactccagcctgggcgacagagcgagactctgtctcaaaaaaaaaaaaaaaaaagagaaaagaaaagactccgagggatcactgattccaaccatatttatttcacagatggggacactgaagcaaggaaaggccaagtggacagcagggggtataaccatggcacctgaggaggcatctggaggttggggcccctgctctcccttctccccatacatctagtccaccagcaagttctggggataccaccttttaaatacctcttgagtctgtccacctctttctgtctcttctgcaaccaccctagcttaggccctcatcatatctccgctggataatcacaacaacctcctaactgatgttcctgcagcttcccctgcccctcttccatcctctaccctgtaagccagtggtttctctttgctcttacaataaagagcgaatcttctccttggcctccaaggtccttcgctgcctggcccctgctgccgcttcaggtgcatatttgttactttctattttgctttccgccttgtcacaaggcctttttgtttaacaggttcagcaacttccctaaggtgcctcagagagtcaaatgccagcctctcaatttccagcacatgctgggctcatgaactcctgttctgaggagctaacgctgtttcctccctctaggtgcctgactgacagaagttcttgcccccggggagctggtgtggacagaggaggggtgagtgttctggaggcacagacttattctccttctgctgaggttggacgaagaggtcttccaggccctcggcctctcgatttttgacatatttgactgctggggaagtgtgaggctttgtctacgccacctgtttctggtggcgctgaaaacgggggccatgctggggaccctccctggttttggcttgttttgggttaggggctgaaatgcatattcatcaagctctgtattcaaaaacaggctttgcctctattgctcatccatgccaccgtggctggtgaaggacggtgctgggcctggaagctgccccgtggcccttgcctgcctttgcttcaccactcctaggtcgtagactagattcaggagagagtgctttcatcctggccctgcccgttgactactacatgaccttcctttctactggcctcagggtcacatcaacattggtggatcaggggatgggggaaagtagggtcagactaaatgacttgttttcaaactttccagcagggaactctcctttttccattgcaccccaaagaatctcaatgtacaaaacagctaaaggggttgcagtgtgggttggagttggcgtggggctggccaattcctcagcccccagacaatgcaactgaccttttcttggctttatggaagacactttggaaaccactggcccggggcgtgtcaaagcttcttcccaacttggaggtgctgtgattctggcagggcgagggagtagagagggaactcagccaatggagttacattgattgggaaatttcgaagtaacatgcaaatgtcactgtgatgttattagtaaggcacaattgccagggctgtgatgttgtcattctggagtcctctggtttttaattttggttcaatgtgaagtatctttgtacccctagggaaactttccatttgtgtgtgtgtgtgtgtgtgtgtgtgtgtgtgtgtgtgtgtgtgtgtacacatgtgtgtgcacctgtagggagcgggaactatggggaatgaagtgtggctgagccaggctgggacaggtagaatgaatggtgggcagagctgggagcatgttgctcctgggggtggtgggggtagggggtggctttagctcggttaaaaggagcgatttggctccttcctacaggggccccatggagatctctgggcaggaagcatcgggaacaaggaatcctctgtccacagccacagcacagccggacagaggaggtggattaggagttcccgggagggagcctgctcagcctttccctgacatttgggcaaatgtgtggggagatgcggagctcaaggtatgtgcgcatagggaaggtggggctccgttaaggggaggttgagatcggctcatacatttattccacacgttcctcaagcttcctgaagcctttcaaggagccaagctcagaagcagacaattctgtaggagtcagagccaagaaagatgagactctaggtattaaccaccatcagtttactgaaggagacaggaaatgtgagagataatagactttcacaggcagctgggtgcagtcggagctagttggccgtgtgtctagagccccacattcaagttcttgctctacagtaatggtctcatgacttcccctttctgaaccctcatttctccttctgtagaatgcagatgaacacatccgccctagctacttctcagtgcttttctaagtgtcaattagaatagagtttttcaaatctctttgggcaacagaaacccatattgtaagcatttgtagcagaacttgtctggttctggggcagtttacccagaattttgccctcctcgtggcttagtttcctgggtgcttttggagatacctctgcaaattcccagggctctaggaagcagggtctaaagaccactgggtcagggtattcttgagaacatgctttgaaaactgcccactgcaacccaggtgataggggtggtgccacatacacaagagtagttataatactggcttctgcttggccctgcccatggacagcactgaccttatcttagttagggtctatacaattgggcatggcttttttccagaaaccagtgacaaaaacttaactcaaagtggctttaaaccaaaaaatgactttagtggatcctggggcagttcatgggactgaagaatgaagaatcaggttgactctctctctgccatcactgcctgtctctcccttttaagctgtcctgtgtcccagcttagcaatccaaacagaaaagggagactctttttcttctagaatctgtatgtcaatccaagggaaggactctgagtggttcaatcactgttgctgggaggataggaatattctgagtggccaggtgtgggtcaggtgcctacctatgtagctaacgtaggggcagagctagcaccagacaccgggggagtagaaggctgttggcagaccacgagaacatgctaggatattagtggagctctaggttgtaacagctcataggcctgcagggggctgtaactcccctcttcagttatagtaatgcaaatgccaacaataataacaatagctaatgtgcattgaattactctccctgtaccaggcatgttctattgttttatgtgtattctttcatttaactgtcatgacagtctttgggtaggtcctattattactattatttccccatattatcgatgaggaaactgaggccctgttaagttaaggccacactttgagtaagtaagggagctgggtttcaagcccaaggtgtctggcttcagagaccatgctctgactattgcatctccagcctctgtttggtaggccaagtggccatcttgcctttgcttgtatgcacggagctcacgacttacagaggcagcccagttccaggttgcactgctctgcctgttggaaagggcttccctatgcagtgcacatgtctacctccatacaaatccatccagccagcatatggctgtgtgttaggtgtttcaggagatgtcaagacaaatcatccataaacctgcctgaaaggtcatcatcacaataagtcacattacttacattgtgccaggctccatgctgaactctttatgtgcattatctcatttaattgcagcaacagtccaggtgctgtggctcacacctgtaatcccagcactttgggaggccgaggcaggtggatcaattgaggtcgggagtttgagactagtctgaccaacatggtgaaaccccgtctctactaaaaatacaaaaattagccaggcgtggtggagcatgcctgtaatcccagccactcaggaggctgagacaggagaattgcttgaactcgggaggtggaggttgcagtgagtcgcaatcgtatgactgcattccagcctgggtgacagaataagactgtctcaaaaatataataataataatagttgcaacaacaactccagagagtaggttctgttattgtccccattttccaggggaaactgaggctcagagggaataagtgactaagaaactgcaaagctgttatttgagttcaggtctgcctagctccagagcctgtactacaacccagtgcagtcagctatgtcccctagaggggaatacatgtgtgcagatgtgattgtgacacagtcagcatgcaaattgccactgagagggacaggaaaaatgcaactggagtttagaggagagaggtcagggaaagggggagaaggggacatttgatctaagttgaggggaactaggatttggacattcagttcagggagggatctccaggaaggtttggaagagagaagcaggggtagtgaagtttgggggaaccaaagagctgagttgggggtgaggatgaggggtgttgtggccagctgtgctttcaggccccacagaaggtgccttcttcttccagactgttctcttctgagacgtgaagaggtttgatcttctccaggagagctcaacacaggtgcccatttccttcctttcctcctgatgtgaggtgggcaggccctatctggagggtagacaaggcacctgggcaccaacagctgtcagtgcttcattcccttcttcctggtggtgaatggcaggaaaaatggtccattccccggggatcagcactttctccagacagcacagtgctccaggcaccagaatggctggactagccattcaggagggttctccatgtcctccctggacagcaggctgaagcatatgcctctcacccatggaggggctcctttctcctgtgccctcccttagctaatctcatccatttgtcagaagttggataatgcccccagaggcctgggctctgtccctaaagtgcctttggatttttctccaaacaacacaggtgggaaattgggggaagagtatgatgtagtgctaggtgctctctcagtttcaaaggatagaagaatagcagttatttttcttgagctggactcacagtgagtcaggggttttattaccccattttgcagatgaggaacttgaggttcagaggaggaaaatgatgacaaatgcagttgtcacatgaaatatgaatggctgtgccattgtctgctgaaggagggacataagtgtggagactcaacatggaaaactgccccttccctcccctgctcttgcccaccaattcctcctcctgtggcagtggctctgaaatgctgactctggctaccctagctgctctccatcctctcttctacatggtagcagatcattcgtcctggattgctgcctgcctgagagctggaggggtgtctctgggggactcaggcctcaggaatgttgcccacgtaaggtccagacatccagtatttcttctgtgactcttacagtctctggagtccctggatttctccaatccttcttgaaggaattccagcatttctgtaaggggaaaagaggcagaggacagaagaattctttcataattcttctgtccttaggatccttcaaccccatggcccttatcacctggctcacactagaactagaatcaaagtccttcatattcttttctacaaagggcttttcaatttatcatctcatctgattttccttgtaatcctgagagataaggcaggaagggtataattatccccattttgtgggtgggttaactgaggctcagagaaggtaagtaacttctccaaggttacacagacagagcagggctagaagatagaagccagtgtccaggaatcctgaccttacttctcagtgcccagtgctgacagctactgggacagcctctggctggcctcttagtccctctctacatccaggactccctctctggttcagcccagtgtgggggaggagtcatgtccccagttcagaccttccaggcttcctaaggcctccagagtaaagcctcactcaccacttctgtatttgagagttccccaaatccagtcccaatccactgctcttgccaatctcagctaacataacaggctagtcttttccttctgacaaagtagacaagattagccatttgttaggggggcatccctctgtgggatgttggatgaatgggtttcagcctgcttgctgctgagggaatagacagggaaactgaggcaagggtcagcacaatcgctgcattcaggacagcttagagaggcaaggctaagaaaaggcttggactggactaatacgatgggcctttccccaggaaaatctactgctttgtttcattaaataaaacacagatggtgcgtgcctataatcccagctacttgggaggctgaggcaggagaattgcttgaactgggacctgggaggtggaggttgcagtgagccaagatcgagccactgcactccagcctggactacaagaacaagactccatctcaaaaaaaaaaaaagaaacacagagtgtactgagtgcctatcttttgctctacttctatcccagagaatatcttccaaggggcaccttaagctttgtcagaaaagtagcacctgggccaaaccagaaccagagacccaggttcctaaggagcattggagtttacagctcagcacttgccagaacaactgggattctggaattagtgatgatgattgcacaactccgtatgtaaatatactcaagaggagtgaattgtatgctgtaaagtggtacattttatggcgtatgaattatatctcaatttttttaaaaaagaatacctgggattatattagagcatgccctgcacatgtaggtgcttaatagatgcttaatagatatttgttgaatgaatgcattaatgaatgtaaatttatttatttattttacttaaaaattttgttttgatataagaacatcttataaagcacatttgtttgatcctcacagcagctgtaaggaggacttagggcaagaataatgatccccatttaacagataaagaaacagaggcctggaaagatgaaatgacttacctagggcaattgaattagagttttagagagttgaaataagtttttatgctatcttctccagcccttgattcattaagcaaaccttaaccaagcacttcttctataactgagctatccctgagatgctgagatactgatatcaatgtgacaagacctctctcattccccagtagttgagagggagactgggatgaagaaccaagcactgacatgactaatcacacatgactatggtgtgattagtactgaagggaggtgggctcaggggctgcaatgcccaaaggggctctggccagccctggggagagcagggtgactgccctggaggctgacagctgactggaccaggaaggatcagaaagatggccaaaagaaagggcaaggtgtggctgggtgtggtggctcacgcctgtaatcccagcactttgggaggctgaggtgggcagatcgctggaggtcagtagtttgagaacagcctggccaacatgtgaaaccccatctccactaaaaatacaaaaattagccaggtatggtggtgcacgcctgtaatcccagctactcaggaggctgaagcaggagaatcgcttgaacctggtagggttgcagagagtcgagattgagccactgcaccccagcctgggtgacagagcaagactccatctcgaaagaaagcaagaaagcaggaaggaagggaagggaagcggaggggagaggaggggaggggaggggagaggaggggaagggaggggaagggaaggaaagggacaaggtgggcagggtagggtatcttcatgtcagtccagggtgcccttgaatcctgtgatgagattagggctggctttgattcagaagaacaggaggagtcactgatgaattttaagcaggcgaggaacaatgctagattgcccactgccctccatccagggcaagcccatttcagccctttcttcaataccactctccctgcccgccctcctcctctgtaccctctgcgctggtcacacggtgagcctgatagaggtgaacttgagcccaggggtcctctctcccagaccaagctagtccttgcttcatcactccaagtagccctcctcagtctgagtccacccctgacattgctgttctggccttcagctgatcacagctagaaactgtcggtaacattagcactaagcgctaataaccattaaaacagatgaccatttaccaagcccctactctaagccaggcgtggttataagtgattcatttctgtatcacttaaagtcatttaatcctcatcctaagaaatgggttatagtataatccctagttggcagatcaggaaactgaggcacggaaaggtgtcataatttgcctaagtattggtgaagctgggattcaaaaccagaggctgtgctgagtcttatccgctggactgtagagcacacaggaggaaaagggcagtcagtccagctgaagactgagtgagcaaagagggactggtccggtgaacttggcaaaccacagaagcacacacaggccttgaagtccatacattccatgtgacgggcaatctgccttttgcctttgaatctaggatttctgaagctctaggccaaccgtgtccctgtctgtttgatgtagcctggctggagcctgagccctggacaaccagattcatattttctctctcatctgtttctctttctcctaccgaccaccccagtgcttgggcctagaaatggattctgcctccagctgctcctccactgggtcctgatttagtccgcaaatttttattaaaaactccaattttattggagttcctaccatactccaaacactgtcctatgtactgggatacagaggcacacatggcaggtaaacacatgctatggtctggatgttagtgtccccttataatttatttgttgagatcctaaccgccaaggtaatggttttaggaggtggggcctttgggaggtgatgaggtcatgagggctccaccttcacgaatgggattaatgtccctataaaagatcccagagcctttggtagttcatgagcatgatgattgggtgttcacgcatgggggtgagatgtgccgccttcaaaccttgttacaatgtacaatgtgaacgcattacctgtctgacatgaaaaaaaaaaaaaagagagcgatctcagagagctagatttcctttctaccatatgatgactagaaggagccatctctggaccagaaagcagccctcagtagacacggaatctgctggcaccctgatctttgacttctcacaaaaatgtgagaaacacatttttgttgtttatgagccacccagttgatggtgtttggttatagcagcccgaaagcagaacttcatatcgttctctggcatttcccaaggggtagtgacaaagatgtctcttggttcttccatgggatgcatgattttgaatttggaaaaatacctctgttgggggaggtagcatgtgctgggagcccatgtgctgggggtcaggcttgggctgtgatccttcctcttctgtggccatgctgggtgaccttaggctggttcttgcctctctctggtcctcttcctccccatctaccaaaaggggagatgagaacagtccctggcatttgtggggcatttgcctggcctatgtgtcatgtgctcacaggagcccaggctgattccaaggtcccttcctttctaacatttggttcctgggtctcacaggccctggaagtgaccactgggctgagtagctcatcagcttccccacactgaagcccgaggggtctcctgctggcttctgagagctgacggaacaggttccagcaaggcagaccctgacacagaagccagacctgtccagcagggaccccatacactggtgggtgtaacctcttattatttcctttgggcaggaagtggggaaggctggagtggaggtggagtgagagcagaccttcaaggcccctgaaactacgcacttaacctagttctgccttgtgaagggtggtgaaaccaaagcccgagaagggcagctttccccaagactttgccaggtgtcaccaaactatgctggaacccagatctactgatccctgcctggtgtcgtgtgctcagctgttcctgggccttgctcacggagtaggggagggcaaaggatagagcgtgtgtgcacctggccaggtggagagtggccacattttatcccgatgctatggttgtggggggagaagtgtctccatgtcatttgtcatgtttccctgcctcctgtcatgtttctcagataagttcctgggtctcttgcccaactgacgcaaacagcctataggttgagtgtccagaggagggggcgatgcagagggccggcctttgtgccaaatggggacaggaggcctggtgagtcctgctgtacaccattcctggtggtggagccgctcagctgtgagcgcccatcctttctctgggcagtggccatgtggcctaggctagcaggccctggaagagcctttctgtgtccttcctggttcttggtgtctaccgcctcacccacacccctgaagctctgggctttgctactcagctctggcacagagactggtttggcaggtttggccacacccatgagcagtgcgatggctgggagctggggtggagcaggcctgaggaggcagtgctgccctgtccttacccccatacccccaaatcccagcctcacttctgccgccttttctacctttctcaagggaggcttcctgggaaactggaaggcagaagccacgcagacttctagtcctggttccactgcttactcggtatgtggcccttggccagcccctttcccttcttggacctcagtttcagcacctgtacaatggggctttgggctcagtgatcctcagacagccacgttgtatgattctagttggggttctacgattttctctccatccctgaacaaacgatagagcactgactgccacaggttccacctgggtaaaatgagtgcctcgacccttgctcgcttcctggagatgtcgataggatcagccaacatcctagcaagcatccagtctccatgggaaagttttctttctatagtctggcctgcccttatctggttcaagcagaaggagagaggatacctagagatggggctttctctaggccccctcccatgctccacttaccctgagaccataattgactgagaaccaggctttctgaacgtctccatgatcgggggggaggggcagaggtagagaacaagaatacagaggaaaggccctcgcacttgctgcctcctgttcctcccgaccttcagaccagcccagggtctagtttgggggaagaggggaaggcagaaaaattccaccactgctacaggccccctctgtgacactgggaaaattgtgtactttcgctgcacctcagtttcccgatctaacgaggaagacacatgtcttccagatcacatgtcctcagaaaatttaagttctggtttttttgtttgtttgtttgtttttgagacagaatctcgctctgttgcctaggctagagtgcagtggcgcaatcttggctcgctgcaacctccgcctcctgggttcaagtgattctcctgcctcagcttcccaagtagctggtattacaggcatccaccatcatacctggctaatttttgtagagacagggttttgccatgttggccaggctggtctcaaacacctgacctcaggtgatccacccaccttggcttcccaaagtgcttggattataggagtgagccactgcgcttgggcagaaaatttaagttctgacaatgtataggtcagaagaaggaatgggagttagatgaagaggacattcccagcctgagatgggggctagagagagaagaaaaagggaattaacattcagtgagcacctatgtgccagtgctatgccaattactttgcatacaatacatacaccatctatattcccaagtctcctttccaagtggcagccagagtgaactttgtaaaacacaaatttggctgggtgcagtggcccacacctgtaatcccaacactttgggagtctgaggtgggcggatcacgaagtcaggagatcgagaccatcctggctaacatggtgaaaccccgtctctactaaaaatacaaaaaaaaagaaattagccgggtgtggtggtgggcgcctgtagtcccagctactcgggaggctgaggcaggagaatggtgtgaacccgggatgcagagcttgcagtgagccgagatcgcgccactgcactccagcctgggcgacagagtgagactccgtctcaaaaaaacaaaacaaaacaaaacaaaaaacccaaaaaacacaaatctgactatgtcactcagtgactttcctctgcccttagaataaaatctaaattccttaccatggcgttcagagccctgagtgagccggttcctgcctcccccttccagccatctatctctattggtctccatagatcattggaaattattctattggtcatttccgtcagccacaggagtcttctctgttcatttagcaaatttattccagtctcaagacctttacacatgcttaggttccctctgcttagaattcttttcctggctctttgccgccttggctccttcttatcctctacgtcgcagtttaatttagtcctcccaccccctgcactgcttttttcaccacctcttgattccttcataatgcttatcacaatttgtagctatttgtctttttcttttaatgtcatgttcactcttgattccatgtggcatggcgcacagtaggtattcaataagtatctattggatgaatgaatgaatgaattgtaaggaaatgagagagtgctggttgagtgcctggcatagggtatggctcttaggaggtgctcaataaatggcagcttttagtgagaactgacatggcagagaaaataaatacccactgatagattgcatacatggtgggtaggggaggcagcgggtaattaagattggaaagtgatgcactcgtgccagatcttgggggtccctgatgctcagccaaagagtttagacttcctgaaagagtagctggaagtcattgctgggccattaatgtaactataaagccctacttctaagatgtgggctcagccactttgcgtactcaaggggctgtgctgtatggtggtggggttgcagggttggggacaaacccagagagagacaggctgggaacctttctggtgtcattctctgagacaggctattcctacaggcccagaaggaggggacacagttaggagcatcctgtgttttctgattccacatggccattacattgtttctggggagtggaggataggggtgacctaagagtcagatgcttggatttctatttgagcccctccccttatcaaccgtgtgacttctgctaggttcatttgcatttctgattctgtttcttcatctgtaaacaggctgctgttcgtacctgcctcatggttttcttggggaggatcaatgaggtagaacctgcaaagggcttagcagagagcctagcacctactgagcgctcagtaaaggtgagctattatcttccattcaacagtgggggattcagaaaggtagattgaaccacaagtgcacagaggcatgaaacactttggagtggcaggagtttcctgtgtgtgttggggacggcaaggaggcaagtggagtggcaggtgggtccagctcctgcagcccgtgtatattgaccaggagctggcactttatctggagagcgatgaagacactgcagggtatcaggttgggaatgatgtgatctgatttctggcagtgggaggatgaattggaagggtaaggctggagaccaggagacggatggtagtctgttggtgtggcctggtgagaagtgatgggcttcatctcaggctcatggaagtgtagaagagggaacagatcacagagtgagtagagacagagaacggacagtgtggggccgatgggtcttggggaagggagggggaagaaaggaacttgtcctagatggctgcagactttctcgatggggggctgacgagattataaaaccgaaagtatggacagtgcatgtgggttttgatgcctgtagtttgacttttctgggaattcagtagctccctgagaaacctctcttttatctgactctctgtgtagaaaatctttctaaaatctctgaatgatgactcctccattagggatgaggaaggcctcctgtggggacaccgtgcatacctcctaaggaggggtggcagcttggcctcctttggtggtaacaaagctggggattttatttggaagctgtatttcagagtctatcagttttcttgtgattttcttcaaagcatgtacaaaaaggcagttccagttagtggaattttttttttttttttttttgagacagagtttcactcttgttgcccaggctggagtgcaatggcgtgatctcggctcactgcaacctctgcctcccgggttcaagcgattctcctaactcagcctcccaaatagctgggattacaggcatgtgccaccacgcccagctaattttgtatttttagtagagactgggtttctccatgttggtcaggctggtctcaaactcccgacctcggatgatccgcccgcctcggcctcccaaagtgctgggattacaggcgtgagccaccgtgcctggccagtggaatgttttgtgtatttattccacggctctggaccaagactaggcaacttttcaagagtggtgaaaggtaagctcctgcgtgctccctctctctgttattttcttgattggtgtggactggaagctcacattccagagaaacttaggtcttagattacccgtctaattttccttatggatgggaacaagagaaggtgcatgaaagttgctcatgattgtgaataatgccacagctgggcttggcccaggcacctcactggcagctacaggctttcccatggcatgcagctggcactgcctctggagaggaggataggggtgatgaactgatgaacatcagcacagcccccggcccatctcagaggcacacacctagtggcagcgggagggcccccgcagactggagaggactcagctattattgtcctaagcctctgacagtgaggctcatccataccccgcctcccatctgagatgagctcagagatatgactgaagtttcagggctaaaaccaaagggattgggttggtacccccttcttatgagaaaaggagaggagagccctgtctgggtctggcggaatacagtctgcatccccaccccagctgattgcagtgatgaggagatgcctttgtctgagttgccaggggaaccaaagtttctgccttcttctaaggccctgattggctcctgctggagcttaagctttggtgaatggaagggcctctcttctgcctacaccttccctgaggtgagagacgagtaaggctggagtccccatggatgcactgtgttggtgtctctgtcctacctccttagctgggggtgctggatccccttgctcattcgtctttcactaatcctgggcagcatctgccccaggcctttcatccttctaggtccaggaaagctagcctaagaatcaggaaaactgtataccaatcctgacataggcagactcactcttggccttgggcaggtctcttctccctgggcctcggtttccctacctgtaaaaatgaaggcattgggctaaactctggtccttccagctctgacttccctgaccacacagcccagatcccctctctgaccttccatggccctcctcgtgcctcttgtgtgcctctgactgcattctctctcgtaggttcccttgtaagatgcaggtcagaatagggggttgtaaccagccttgagcattgttttggttttctgtaggaaaaattgtgctccctgaagcctgtcctagaagccctacatcctgcaacccctcttgtcctcatctgtctcacctggaccgagccccagggtcagaagcccgggggaacgaatgatgggtgcttgtgtctgttgcagggtggggctaggcagtgtgcagaaaggagcatgtgggggtgggcgggggcagctggaagagccctggagctcagcagtcctgggttccaggcctaatttgtctacctgctggctatgtgaccttgggagggtggctcagttgcagtctccccatctatcacacaggaataataatgccacctcacagggcttgttgccaagatgacatgtctgccatacaggagacaccaagttcccttccctgctctctcttctaaacaaggcagggagatggggaaagttcagactgaggaggggccctaggctgcaagacctgaggtgccccaggccgggccttagatgctgctcattcctggcagtgccaaaaagcagggagaaaaaagtattggccttgggtggatgggggaggctgtgtgtcagagctaatgtttaaataacacttttaagatcctccagggacctcaaatgaggatttttcagatgagctgaaaatggagcaaagtaatgagactgagctcactggcaggaaagggagcagccttaattggtactggccctgccttggccccgtgacactcattaccacaggctgcccaggaggatgacccgtgcatttgggctgtaagcaatgtcaatttcttagcatggggtgatggggttgcatctggtagtgactcagccctgcttcttgtcgactcaccaggttgagggtcagagaggacttcttagttggccttcagagcctggtttagtttttagctttgtgacctagcctctctccacctctggggtctagaggcagcagccagacctggccactgtctgtcacaggtgtggtgggaggcagggatgggatgttgaagtcaggcatgagttgctgggggaccttccctcctttgctgaggtttgcctggggtcctggatgaggtgggtggagagagggaggaaggggcattctcagaagaaaaaaggctggtgggtgtgtgggtgggtgaatttgtgccaatgagatgtgactctctgggcaagcttgtgtagcttacatggaggaggcacagaatctaagggacatgtctcaaagaggctgagggatgggcctaagaagccagcatgggtgggggtgaggggtgggtcctgggagtggtttggtttgcgagtccctgtggaaacacaggtggtagaattggtgaatggtatggaccaagagtcctattctgaagacaccagaaaattctgaccaggctcttgtacgtgaggcctcttctgttttgcttgggctggactgcggggtgaatggccacgggtgtggtaagttaccgcttctcctggggggagcctggtttgcattgtaaatactgctcctggagccactggtcatggtgggggcactttttcagacgccttcctggggaatgtgtgagggccgattgttagatcattcttggcacctggtttgcattatgaatgcagttgggaggcataagggcaagcattgggtcactagcgggtcccaggccaccctgaccccaggctcactgctcccgaagcactccctctccttggtctctgggacagcacaccccactttctggctttctcactctggcctgccctcatttgcctgttgctgctcctctccttaactgttcagtgtgtgggttcctcagggctgcattgcagttattgtcgtttttaaaataataccgttttttaattttaaaaattcaatttattcatttattttaaaaattacaaatgagagctcattatgttggccaggctggagtgcagtggcaactcacaggtgcaatcacagcctcaaactctttgactcaagggatcctcctacttcagcctccagagtagccgggattacagagtgtgccactgcacccggcaggtttgttttttttttttgttttttttttttgagacggagtcttgctctgtcactcagcctggagtgcagtggcgtgatctcagcttactgcaacctccgccccccaggttcaagtgattctcatgcctcagcctcccaagtagctgggattacaggcacccgccaccatgcccaattaatttttctatttttagtagagacggtatttctccatattggccaggctgatttcgaactcctgacctcaagtgatctgctcgccttggccttcgaaaatgctgggattacaggcatgagccaccttgcccagcagtgtttttttttttgttttttttaattaaaaccataataacatagtaccaagatttgggaaaacaggaagcagaaaaaaattactcctgaatatgattgggagcttggagtgtttcctttcaccagttttcctttgctctttcttgcacagtcataatttctaccgcatcatcagtactgtcctgcatttttctcttaatgttgtatcggaagctgccttccgtgtcgttactgaggattctattaaatacacgatcaactcatcccttttcctgctcatggatattccggctgtttctagtttttgctattatgaataacagtgcaatgaacattgcataaaatgttcttcctgtatttcagatgatgatgtctcttggggtgaagacccaggaagagaatgctgggtaaaaggctgtggctgccttagaggctctcagtaaacttgccaaactgctatgccaacctttaacccccagcatccagggtgaatggcaggaactgttttttatttttctctctctctctatttgatttttaaaaatttctctctctctctctctctctctctctctttttttccccgagacagagttttgctcttgttgcccaggctggagtacagtggcatgatctcggctcactgtaacctctgcctctgggttcaagggattctcctgtctcagcctcctgagtagctgggattacaggagcccgccaccacacccggctaatttttttttttttttttgagacagaattttgctcttgttgcccaggctggagtgcaatggctcaatcttggctcactgcagcctctgcctcctgggttcaagtgattctcctgcctcagcctcccgagtagctggggttacaggcatgtgccaccacgcccagctaattttgtatttttagtagagatggggtttctctatgttggtcaggctggtcttgaactcctggcctctggtgatccgcccgcctcggcctcccaaagtgctgggatttcaggcatgagccaccgcgcctggctaatttttgtatttttagtaaagatggggtttcaccatgttggccaggctagtctcaaattcctgacgtcaggtgatccacccaccttggcctcccaaagtgctgagattacaggtgtgagccaccacacccagcctgttttttatttctcttaggtctgaagagcctgttccttgtgtgtagggactgctcccaactgtcctctgtccatgcattcattcatcctaaggcgggaggcagaatagggctgtggtgtcaggctgcctgggttcaaaccagcctcccctcttaaccaccttgtgtccacttcctcagctgtaaagtgaacatcatgacagggagctacctcacagggtccctgtgaggctttctgtgcatgaaagcatggaagacacttgaaatactacggtaagccaggatgacaatggtcaggcctagagagaggaaggggctgatctctcaccacctagtgatgcaggggcagagctgaggccagaatcaggcttcctgcctccagtgctctctttccctgatgccaggctactgctgtggatggtgtggtttatggcgtaggtggccctctgttcaagaatatgtgggaggggtggagggcctggatggatctataaggtggggtctctccctttcctcccagagccgtcaccttctttctggggtgctttcccccacaaagttatctctctaggttagagcttggggccccagctcaggcctgttccccagaggtatatccaggggacatctggccccaaggaatctccctggctagcccttgaggagggcgtttcagtctggagggaaaggtgagttctgaggacccctccctaggtgactgtgtcagtttcctaatgctgccctaacaaatgaccatatacttaaaacaacacaaatggatgaccctagacttctagaggtcaaaatctgaaaatggaccttatggggccgaagtcagggtgttggcagagctgctaggggaggatcctcacctggccttttccagctctccaggccacccacatgccttggttcatggccccttctagtagctgggtccctcccacctctgcctccgtcatcatatctcctccgattcccccaaatccccttttgacttacaagaacccctgtggttacattgagcccattcagataatctaggaccattctccatctcaaaactctttacctaatcacctgtgcaaggtcccttttgccacgtgaggtaacatattcacctgattctggggatgaagacatggacatctttgtgggcggggggggggggcgcattattatgcctgccacagcagccagtagcaaagatctctctggattactggacccccaggtcctgctggaattgtaccactagcctccaagatggagggagggcttgggggtccaggcctgatatgctgtggccggggaggggtatgagagattctgtatgatggggggcccggaaggaaggcagtgcacctgtgatagtgtgataaatgtgttcagtgaggcagacattgggaaatgtcacccctggccttcagaggtagtcctggtaggtgtgggacccactgtgaggcactgccacagaaagccaagcagcacccgctccacacaccaccatcactgctgtgtgtgtacacgtgcttgtgggtgtgtgcactcatctgtgtctctgcatgaatactcttgggagggccaaggaacaactcttgaaaaaggtcctttctgctcttgttctaagaaaaataattacacaagtgactaattttatccctaatcccataattactttattatgtagctggtgagagggcccgagctgtgcctttggctccactctggctgttagcccagttggcctggtccaccagcgttgagccccgccttgtttctggcctgggactgccatgagggcaagatgagttccattctggctgagatccaactaccctttggtatttggggtctgaaaagaccaccatttcttcccaccaagcccatgcacaaagtaagagcttgtgtttagggaattaagtcagtagattcaagagatctgggttctagttcacccctctcattaacttgctccctgaccttgagcatgccatttccctctggatctcagatctgttgtctgtgatacagggccctggccagcttaacactccatgattccatgaggagaaatgggaagactagagctttgagacagaggtaccttcttgctacctgctgaaaacataccccaatcatagcattaaagataatattaatagtagctgggcacagtggctcatgcctataatcccagcactttgggaggccgatgcaggcgtatagcttgagctcacgagtttgagaccagcctgggcaatatgcaaaccctgtctctacaaaaaatacaaaaattacctgggcgtggtggcatgcgcctctgtggtcccaactactcaggaggctgaggcgggaggatcgcttgagcctaggaggttgaggcttgcagtgagccgagatcacgccactgcattccagcctgggcaacagagtgagaccctgtcaaaaaaaaaaaaaaaaaagtaacaataatatccatcattacttgatagcaaaccttgtacctgattcttcatttatatttttctcattctatacttggatgactaggtgaggtaggttttacggaagaggaagctgaaccagcagttgataaagtgactcacctgtcatgaaatggcagaggtaggactgtagcctatgctcttagcctctgcctccattgtctttttctactgtataaataaatgaagggccactcagctaggaagtggcggggctgggatttgaacccaggtctgtctgtctccaaagttcttgccacctcccagaattaggcttccaggggtgattatactcttgaacttcaaatatgtaaacttaagcttgacacaacaagaaatagcgatggtgaaataaattggaaactccagtagaccagagagttggtagcccgaggttgtgttctagctttgccactggctcacgctgtgaacttaagcagatccccactaatccctaggcctcagtgttcccatgtacacgaggggtgggattcgatggtatccaaaggccttcctggtattgatggtttgacattctaggccatctggtcccagaaggtactgtggggcaggagaccagctcatggtggagaccaaagggtgggtgagttggcagccctagttttttctattacatttattcccacgagaatagagattgcttggactgtgtcccactgaacatttgcagaacaacttacccaggccatggagttgagaataaagagtggaggaggtagtttccaggctgttcctgcaaggttactgcccagcctgggctattagctcctcaggggtccaggtctgtcatctaccttgctccaaaggctgcattggtctcaggtaggcagaagcaatggctgcacgtctgtctgtgggagtctgtgagggtgcctaagcataataaataagaacactattttgtgttttctctgtctttttttttttttttttttttttttgaaccagggtcccactctgttgcccaggctagagtgcagtggcttgatcacggcccactgcatgcaacctccacctcctgggttcaagtgattatcctgcctcagcctcccgagtagctgggattacaggtgcatgcgaccacatctggctaacttttgtatttttagtagagacagggttttgcatgttggtcaggatggtctcaaactcctggcctcaagtgacccgaccacctcggcctcccaaagtgctgggattacaggcgtgagccactgcacccagcctactttgtattgtctattatcacggcctgcaacccactttccttgaaatattacgtttacttctcttaaaaccatatgaggtatgtatatggtcattcccattgtacagttgaagaaactgagactcaaaaggttaagtactttccttcagatcacacaatcagtgagggatagagggggatttgggattctgcctccagagcccacggtcttggccttagggactgataccacatgggccgaagcaataagcatgaggtcaggagtcagcgggtttggaatcccccctctgctcaccatctgtgtttccttgggcaagttactttatctgtctggatttccgtttctctctccataaaatgggtatattaatacctgccagttgggattgatttaaaggtcactgagatgatgggaagtgcaagtgtctagcctgtgggctttcacctcttgcccctgcctccttcctgcttccctctacatatctgaggctctggccaccctggaggtctcccacgcatagctcttagcttaggcctttgcacaagctgctcttctgcctgaaagttgctgtctctgcctgttgttgtaaagatagacttccttcacatctagacttcgatcctttactgtttccttgaggattctggaaaggggaaggggtgaggtaggttctcccacaggcctgttcagtgattatcaggacaacccctcggtaggggcagaattgagggtagcaggtagggtcctgaacaccctggaaatataaatccctccagaaaatttcctccctttatacttgacagcttaggaagggcgtgcatatgaggtgagtgtttcgtctttggatcattaaccttcctattactgtggtctcactttttcagttccccctatttctttggcatcatctcatggccttttactttcttgtttggttttcttgctagaacttacaaaaaaattttcaaaattgtggtaaaatatacagaacctaaaatttaccaccctgaccacttgttttttgagggagggtctctctctgttgcccaggctggagtgcagtggcatgcccttggctcactgcaacctctgcctcccaagctcaagcgatcctcccgcctcagcctcctgagtagctgggactacaggcacatgcaactgtgcccggctaagttttttttttttttttttttttggagaaacagggtttcaccgtgttgcccaggctgatctggaactcctggcctcaagtgatccaactgcctcagcctcccacagtgctgagattataggtgtgagtcaccatgcctggtccatcttaaccatttttaagtaagtgtacacttcagtagtgttgggtaggttcatattgtgtaacaccatcactaccaccatcttcagaacttttaaatcttttttctttctttttttttttttagagatggtgtctcgctctgttgcctaggcctgagtacacaggtgcaatcatagctcactccatccttgaactcctgaacttcagcagtccacctgcctcagcctcctgagtagctggggctacaggtgcataccgtggtacctgactaatttttttttttgtaaaaatggggttcttcttttgttgcccaggctggtcttgaactcttggcttcaagtaatcctcctgccctggcctcccaaagtaacgggattacaggtgtgagcctgaattttttaattttttaaaatttacttttccacggcagagtattgttctgttgcctagactgaagtgcagtggcacgatcactgcagccccaacctcccaggctcaaatggtcctcccatctcatcctcccaagtagctgggactacacatgcatgccaccatgcctggctaagtttttctttttttccttttctttcctttccttttttttttttttttgagacagggtttcactctgttgcccaggctagagtgcagtggctcaatctcggttcactgcaacctctgcctcctgggctcaagggatattcgcccctcagcctcccaagtagctgggactacaggcatatgcactatcacacctggctaattttttattttttgtagagacagggtttcatcatgttgcccaggctggtctcaaactcctgacctcaagtaatccgtatgcctcagcctcccaaagtgctgggactataggcatgagccactgcgctggggcagctaattaaaaaaaattttttttggatacagattgggtctcactatgttgcccaggctggtctcaaactcctgggttcaagttatcctcctgcctcagcctcccatagtgctgagattataggcatgagtcaccgcacccagcctgaatactttttttatgttttgagactgagttccgcttttgttgcccaggctggagtgcaatggcgcgatcttggctcacggcaatctccgcctcctgggttcaagcgattcttctgcctcagcctcctgagtagctgggattacaggcatgcaccaccgtgcccgtctgattttgtatttttagtaaagatgagttttctccatcttggccaggctggtcacaaactcctgacctcaggtgatctgcccgcctcggcctcccaaagtgctgggattgcaggcatgagccaccatgcccagccaaattttttaatatgaaaaaagtgaaactatatccattaaacaataactcccatttcctcctcccccaacctgtggcagctgccattctcctttctgtaactgcaaattggactagatacctcagataagtggaatcatacagtgtttgtctttttgtgactggcttttgttacttagtataatgtcctcaagttcacccatgttgtcatatgtatcagaattcccttcctttctaaagctgaataatattccattgtatatatgtacaacattttgtttatccactcatctgtcgatggacacttgttgcttccacctcttggctatgtgaataatgctgctatggccttggctgtacagagatctctttgacaccttgctttcaattattttggatatagcctcagaagtggaattgctgggttgtatggttagcactttttttttttttttttttgagacaagagtctcgctctgtcagccaggctggagtgcagtggcacgatctcaggctcactgcagcctctgcctcccaggttcaagcagttctcctgcctcagcctcccgagtagctgggattacagcttctccaccccgcccgctaatttttgcatttttagtagagacagggtttcaccatgttggccaggctggtctcgactcccagcctcaggtgatctgcccgcctcagcctcccaaagtgctgggatcacaggcatgagccaccacatccagccagcacattttttaaagccactatttattgcatgcttaatatgtgccaggaactgggttaatgatttgacatatattgcctcactcaatccctgcgtccactctgagtagtaggaagaattatccccagtttgtagctgagaaaataaagactcagagaggttaagttatttgctcaaagtctcacagctaggaagctttggaacatgcactggagctttgacctgccgccaaagccttgcttttaactattgtgacatgctgcctcccagtggcctctctctccacctgtctatagaattttctgcctctgttgtgtcccattttttttttctctcttgccttgtgtgtgttcactctctctggaaactttgaacaacttaagtaaaggccctttgactgccaagaagttttgtgagttggaaacttagagcgggaggcctgtaatttgctttctaatcatggtcctctggatttatagctgcctgtctcccagtgactgacaggctcttattcagcctcttgtggtgattgccttgtggatccacagaaagccggcccaagagggccagcttcctgggtacagggacgctgtacccccagagaggcagtgtgggaagggagacggcccggctaggccaacgaggattctcttggctcactgatttcctagcaacaacagaggcagaaaattttacagaaaggtgggaaaagaaaggctatgaagtagattccagtacaattgcctttttctgattttcaaaactatcagagcaaaaatattcctaaatttgtttcgagttttataagttcaagccagacttacggtttgcatgatagtcagttatctttctgtcatcctttaaaaaaaatttttttgttatgcaaaatttcaaacatacataaaaataaagagtatagtgtaatgcacttctgtgaacccattgcctaggtttagcaatgattaatacatagagtcacagcttgtctatccaataacacagaagtttaaatttttcctcattcacagcactagctcagcgcttcagacctagttgttgctcagtaaataaatagatgctgactgattacaaagcccttcccctctctgggtctcagtttccccatctgtgcagtaaagggataggattaagtgctttcttcttattattatttatttattttttttaagacggagtttcactcttgttgcccaggctggagtgcaatggtacgatctgggctcaccgcaacctctgcctcctgggttcaagcgattctcttgcctcaacctcctgagtagctgagattacaggcatgtgccaccatgcctggctaattttgtatttttagtagagatggagtttctccatgttggtcagctggtctcgaactcccgacctcaggtgatccgcccaccttggcctcccaaagtgctgggattgcaggcatgagccaccgtgcccggcctaggtggtttttttttgttgttgttgtttgtttgtttgtttttgagacagagtctcgctctgtcacccaggctggagtgcagaagcgcaatctctgctcactgcaacctctgcttcccagattcaagtgattcttgtgcctcagcctcctgagtagcagggactacaggtgcgcgccaccacacctggctactttttgtatgtttttttttttttttttttagtagggatgaggtttcgccatgttggccgtgctggtcttgaactcctggcctcaagtgatccaaccaccttggcctcccaaagtgctgggattacaggcatgagccaccgcacccaaccaggattaagtgctttctaagagacatggtagtcaaagtatacacttggatgtcagacacaattgtttttccatttattagctaggtatcttcaggcaagctgagtctcagttttctcatctgtaaagtggggatatgacttctcaagggtggttgtaagcactgaataaagtagctgttttgttgctaatacttttattattgctattttgaatattaatattctggttggaagaatccgtgtatttcagaaatgcaaaaataaaattggaatggactagaattcatgccctaggatttggcttctttttttgtcccagtcagcagataatcagaagcccaagaaatgaatagtgcaagaggaggcccagagtgagggccatccaggctgatttcatctcctctcttcccctgcccctgccgtgtgtgggtgtcacagcccccacccccatgagagagcccgactagccaccccctcccctaatgagacaggcccaagatggaagagcccacaggtggagagggtggtgctgcaggatgtctcgttgctaagatttccgaggaggcagcaagagcctgtttccaaagctgggagggaatgatgggctgatgagtagatgtagggcatgtggccccagatggggttttgtgggattctgggcaagggacagcagctgggagaaggcgctgggggcaggaggagggtctttgtagaatatggcccctttcatagactgtgggctcaggattacgtgttcatttcttccatttacctccttatctgtcaatatcagacctgcatgtgaatcctgattcactctatgacctttggcaagtgttgtgctgctgtacttgctggccctcagttttctcaccaatgggagggctaagtgaaacatgtataataaagtgctctgtaaaaaggaagacaaagtagaaatgtgaaggttcactacgactgtcatctttattattttttttttcttttactgtcagatgagggaatgggactctgttaggtttctatgcatgaatagggagccctggagggtacttccgctgtgagggcctgtgtcaggagactgtgggaattggctagatgggccccattagtgaaactccagggaacaactgaagagggcagcaaagttcaaagccagagaggcagcccaaggggggctgtggttgctgaaaggtgggggctctagtgagattctaggagggaccttcaatggttcaggccagaagctttgagagaggtgaaggtaacagacctttcttatataaatatgtttacacatatataccagaaagtaagcaacaaaacaagacccaaatgtacacaaaagaaataattccactatcataaaacaacgtctggtaacatgttttaaaatatttcctgtttgcttttttctaggcatgtacacatacatacatattttatagaaattggggccaggcacggtggctcacgcctataatcccagcactttgggaggctgacgtggacagatcacttgaggtcaggagttcgagaccagcctggccaacatggtgaaaccctgtctcttctaaaaatacaaaaattaaccaggcgtggtggcggggcacctgtaatcccaattactcgggaggctgaggtgggagaattgcttgaacccaggaggcggaggttgcagtgagccgagatcatgccactgcacttcagcctgggcaatagagcaaaaactccatctcaaaaaaaaaaaaaaagaaaagaaaaaagaacaaaaaacgtattttgtagaaattggatcatttgttacgtaccattttgtctctgcttttttacctgtattgtgttaagaacatgattatatagccacatatagatccacaacattattttgtgtggctgcgtagtatttcagcatatgtatgtatcactatttttataacgtagccactattattggacatatatattaactccaatgctctactttactcctgtatacagtgcttagacaaatgttcttatagccacatctttgtgtcattcattgttccctaaggatccattcctaaaaaaggaatttctgcgttaaacggtatgcacacttttaaggcttatcatgtactttttcaacgatgaaagatgaaaccagttgatagctgcattgacactgtctgaatctgcccaatttattggcggctcattatcttaataacccggcagcggtagcttagtgggtgggaggctcacttgcacggattgggcggagggaggcatcaatagccactctaaaaggactttgcaaagagaggcccctgggtggcctgatggggctgggttggactgtgttgaaggggcttacctgcccgggctgtgctgtgctgtgctgtgttggcccgactgtattggttatgggaggctgtgctgggcagttgggctgggttggctgcactggctcaggcctggcagtcttgtccctggtgtgatcctgggctcagcctggtgtgatcagcgtagtcaccaatccaagacattcattctagaagctggcatggcctccgtggccatgctgacagacttgtccattcacgtagtggagagtgattcatcagagctggtggtggcagcagtaactctgacagagtggaactgctctcaccatcctgtcacttggcctctaaaaataactcctgccggttccgagtgaccgcaccgccaggtgtctggaggtgcagtcctgtggttgtggctatgtgagggagggtgtgtttgtgtgtgtgtgtgtgtgtgtgtgtgtgtgtgtgtgtgtgtgtgttggggatagaggtgccatctgggggcctcttgattggttgacctctgagccagggctttggggtgggagtatgagaggcagaccaggctcgctcttttctaccctctcatagctggggacagagacagctagtgggggtagcagtatttttcaggactgtgtgctcactccctgctgaaaaagggcagagagagtggaatggagagggtgacttcagaggcaatatgacaagggtgaggcaggctctggggaagcacagcatttagccaatcaacatctatgtcccacaaaagcccacataaaagctcatcgtcttagtgaagtctttaatgtagggttcctttaaattagatacaaaatacaaaatacacacatatacagctaatttcttatcgtggctgattagagatcatctagcccaagtcttaaccaaggggattatctatctatcactcagggggtgatctatgcatgggcttcatgagctctcttgatacctgaaagatgataaaggtaggtatgtgtgtgtgtgagtgtgactttgtgtgtgtgtatgtgtgtgcaggtgcatacccatgtacatttttctaggagaagctctgcagttttcattgcattttcaaaggaaatcaggaccgataaaaggttttctttttctttttctttttttttcttttttcttttttttgagacagtgtctcgctctgttgcccaggctggagtgcagtggcgcgattttggctcactgcaacctctgcctcccgggttcaagtgattctcctgcctcagcctcccaagtagctgggactacaggcgcacgccaccatccctggctaatttttgtatttttagtagagatggggtttcaccatgttggccaggctagtctcaaactcctgacctcaggtgatctgcccgcctcggcctcccagagtgtaagaattacaggcgtcagccactgcgcccagccccctaaaaggtttagaactgcgctagtccaaccccctcatattacaggtaaggaaattgaattcagagaggaaaatgactgcccaagatctcacagcaaaggtcaaatcaaggtttcttgatgcccagcccagcgccctctgccacacaggacgccaccctcccctgcctggttccttgagccagggtctagctacctacagtaggcaggatcacagtaccattttccataccctcttggctggcatggatccaactgaacaggcttgaggctttcaatcacagtgggcagctgagccctcacctccagaccttcccactcccaggggaaaacccatggggcatctcctgactcattcctttagagggcatctttgcccaggacagttaaatctgtctgttgacattcttatcctggtgggacactctctgatacaggaagtgcctctgccttgtgggaaaggaactgaccctcgggtcctggaggacaggaaatagaatggctgagtgggcctgggaatattatatgatggaaaggcaggaggtcatagctagtggcaagagacagatgctgtctcattgtatatgggaggaattaaactgccataggagtgaataataggactgataagtaacatttattgaatacttactataagttagacactcttctaagatatttacatgtattagctccattaatccttataataactccatatggttattataaggaaactgaggcacaaatagattaagcacatctaggaaacaactgagccaggatatgaagtcaggtcctctgactccagagtatacatcactctggagccaaagtgtaggctcctagcctctatgctggcagacctgaaactccagtgtgcgttagaatcacaggagggctgatgaaagcactgttgctgttccaaacctcctagtttctgactcagtaggtctgtgtggggcctgaggatttgtgtacttaagagttcccagataaggctgggtgcggtggatcacgaggtcaggagttcaagaccagcctggacaagatgatgaaacccccgtctctactaaaaatacaaaaaaattagccggttgtggtggtgggtgcctgtaatcccagctacttgggaggctgaggcggagaattgcttgaacctgggaggtgaaggttgcagtgagctgagattgcgatcacaccactgcactccagcctgggcgacagagggagactccatctcaaaaaaaaaaaaaaaaaaagagttcccagatattgctggtgttccagggaccacactttagaatcatccctgtttcctgataggaagagatgaacagagggaaaagaagtggtgactgatctcacctggattattgcaatgtcccactgtggttccaggcttctccttcactccggtcactgagtcttcaccaggagcaaattaattttcctaaagcccagctctaattatgcctctgctcaaagctctctggatcctctgacactatccaccattgctgtccactagaaatgtctgtagtgatgaaatgttctacatctgcaccgtccagtatggtaaccactaaccacatgtggctatgagttttacattttgttccattaaatttaaatttaaataatcacatttggccagttgctagacagtgcagtgcacttggtttgtcattcaaggctctgcttggcaccagctcctttctatctcctcagggatagcctcaaccctcagtatcccaggctccaggtcatatgcagcgtttcctgattctaccttgtaattcccagcactatggcttgtgttatgctctctcctcagtctacattgtccttctgccctgcctttaatgcccaacccacatatgacctcttcctcgaaacctcctttgacacctgctgctctctaatctttttctcctctgaactccccaacactctgtcctcttcttacaacctttagtgctttctgttttacattgcagttggctggtgtgggtactttctcttactaaactgtgagcttttggaggatgtgactgttttctgtagagagctcttgcttcctactgtaggtccctccaggtacacagaggagttcgacaaatcccacaaacctttgtactggcacactggggatacagagatcggtaccataacttccctgtcctcaagctgctcacaggcttctacgagagtctgattcatgcccagagaaccactgaagccaatggttattttaggcagggagataaaagccacagagggcccagttggcgaggggagtccggcaggagctgcctaagcagaaggctgtgtttacatacacagacgacttctctgcccagcctggcctagtgtggggagatgggaacattcaggcgtcactgcctggctgccttgtgaagttgcggattaaccagtgatgcagcggctggtctagccgtctggtccctgcagatggatggatgaagagaggactgaaaagacagcagagcagtgccagcttctggaagtgaagtgctggctgggtggagtgggcacctgggctgggaatgtgagtgcaaggaaatgtttgtgatctgacagcagacagcaggtgaaattctgctgggtctggcttggggggttatgaggtcttcataacagtccctgttttaaatggaaaaactgttgaaaagaaaaaaaaaaaaaggaggtcaggtgcagtgggtcatgcctgttatcccagcactgtgggaggccaaggtgagtagaacacttgagctcaggagtttgagaccagcctaggcaacatggcaaaaccctatctctacaaaaaatataaaaattagcagtgcatggtggtgtacacctgtagtcccagctacttagggggctgaggtaggaggattacctcagcccggggaagttgaggctgcagtgaaccatgatcacaccactgcactccagcatgggcgacagagtgagaccctgtctcaaaacaataataacagcaacaacaaaacagaggaaaaaaagatagaaacagctttctggctttagactctaatcctaagagtattttacatcctgaaaatctctagcatatattcatctctgggacaaaaacattaaaaaaaggaaactttattgatgttataacataaacacagaaaagtgcacagatcataagtttacacatacttgtgtaactaccccccagacatgaacagaatatgtcagtatctccagaataaacctgtgtgaagcccaatgtgtgtaggattaatgatagaacaaacacaggccttggagtcaggcatgcctggggttgaatcctgggcccctgcacctactagcagtgtgaccttggatgagtgatttaacttcagtttcctcccctgtaaaatcaaggtggatctataatgtctgccttacagggaagtaggagatttaaaattgaaaatataggcaagttgctaggcacagtgccagcacataagtggggactcagatgctctctgcaatggcgatgttaattgatggtgatgctgcagcaccttctggcacctgggaccagggacacacacacagcttttctcctgttgcctctcactgctcccagcctctgtatgatactctccagctctcttctgactgcaaggaattagagatgctgtgatgatgcaaacctcagctgacacttcaggcacccgacgggaggctgggtggacatctgtatctagtgggtacatggccagatttttcatgttctggcctcaggaatgtggctcccagacctcctagaggggctgatttcccaagaagcagctggaagcatggggacctattaagaaacatagccgaggtggagataaggcagaactcagcctcaggagtgtcctggcatcctgggtggactcctgactcctacttgctccctggcctctggctttcggtgtgaagatggccaacacatactatgcacatattgtgaactgggcactgatgtgggccttcaggggtgtgtgtgggcggagggaagggagtatgatgaaaagtggccattatcctaaagctcatagtgcaatggaagtttaaaacccttggacaggtcacatgaccctgaacttgagggtggcaggacggagacagagaggccaagaggttatttctagccagaggagttggtgcaaagaggaagggttcaggaacgacttcctggagaatgcctagaagaataactatgggaaatgggaagagggtctcccaggcagagaagagggcacagccactgtgccctggggacctggaaccagtcagtttgacaaagctcatcacatggaatctgagaatgaggctgaagagccaggtgagaccaggctgtggaaggtcttgagagtcgggctgaggtatttgagttgcttcatcagagaatgaggagccactgaagcttcttccattgaggaagcagagccagaccagatcctcttactgtgctctgtggagaccagcattgtttttagccaaagatggcaatcagttgtccaagccactggagcggtctgtgagagcctctgggatgcccagacatgtacagggggcttggctgtgggtatagaagaggaagaggggcatggaccagagctgaggttcccagctttgagaaatgacagtcttactggagacgttggagagcctcatgacaacggagccccaaattcaaaagtagaggcaaggatgagatgagggtccagtaggcagagaagaagaaactggctgggggagcatgcggggcggagatggggccaggctttctggaagggaggcaaccttcagaatgggcaggctttggagacactgagggtactgaggggcaccctagtggggtccatctgaggtgcagaagggagcttggagcatgccagcaccaaacagagcctttgtgggcattcttgcatgtcattctcatagctctggaagacggtgctgatattatccccattgtacagatggggcaactgaggctcagagaggctaaggccttgctcaaggtcatgcagctcctgtgctaataaatgtcccccatccctgccccagcccctttgccagaggtgaacattgcccttaggctgttcaacaacactacactagatacgtatggaaaagtgctttgtatactgtgacctgctatgcagtttgcaggcatcctcatcattccacactagaataaggcttaacgcaggagggtgtggttcccacggtctgggctggatggaaggttacagggaagggtaaggtctctgggaactgcagtgctttgagaggcttcttagagaagatggagaagaggaagtagggggcagctggaggggggaggtccctgcaaggtgggcactgccacctgtccaccctgcctacttcctccacccagacacagctgccctgtggtgccctctgcagagtgccaacctcagtgaaacagcctgccaggcagcacttcccagaatggtgggtcatgctgctctgttaagtttggctccgctagctccctccctctggcccagctcccagtggcctggggctgtcactgggcccggctgccctcccgggcaggagccagctgccctccagctctcttgtcctggaacaccctcctccccatgacctcacctttaacccagcttggcttagtgtcttctcctccaggaagccttttctgatccctatgggctgagttaggaccccagagtatctaaacctgtactgaccaaaagaaatataatgtgagccacacgtgcaagccacacgcaattttaaattttctagtagccacattttttaaaaaagtcaaaagaaacagatgtaattattcaaatgatttgttttatttaacccaatacattcataaggtttttttgttttttttttttttgagacggagtttcgctcttgtcccccaggctggagtgcaatagcacgatctcagcttactacaacttccgcctcttgggttcaagcaattattctcctgcctcagcctctggagtagctgggattataggcacatgccaccatgcccggctaatttttgtatttttagtagagatggggttttaccatgttggccaggctggtctcgaactcctgacctcaggtaatccgcccacctcggcctcccaaagtgctgggattacaggtgtgagccatgcccgagacatattacattctttttggtatgaaatcttcaaaatctgatttttatatttacagcacatttttatttgaacgagccacatttcaagtgctccatagcaactagccatggctagtagctaccatattggttagcacagacctaaaaacagggagtttataagggttgaagctcagagtttggcaccagacatacctgtcagtcatattccgaccctgccatttattagctggatgaactttggggtcgctaacccttctgagcctcagttacttcagctgtgaaagggattaataatttcagtgccagagaattgctttgaggattaaacaaatgaatgtgtgtccagtgccaggcacagaggaagtgctcagaaaatggtggtgcttcaccttctagtatcctctgatgtgctggggtacgtgcctccactagattgattgtgaattcaagggcagaggctgtattcaattcctccagccttccccagtgtccagggcctggcttggtgtgagcattactgcttgctgaatgaaagattaagtccttgggctgggagtgctccccaccccaccctgcttgcccagtagtcaagggccctggtggctgggagtcaggagaccactgactacttgtgggtgaccttggcaagtcactgctttgcttagaaccttggtttcctcctttgaaagataaaagggagataggaggggccctgcctgaagtgtttggttgaatctctgccccgcagtgaccttgggggtctgtggctgactctgtgtcccttgctttcccagccagtggagcgaatcacttccgttctcctcctggctttcctgtatcctggacttttgcaccattaagttccatccagttaaaatttaagaggaaagaatttctcctgcctcctagacagagcagagagggaatgaagggtcctgtcccttctcttctgccagcatctgctgacctcccatcacagcagcccagtgacagacatggggcagggattctcccattttataggtgagaaaattgaggctcagagatgtcaaataacctgcctaagtaatacaaaaagaaatggtagcgctagggctggaagcagaatttgcagctaaggaactgaggaaccccttttttggatgggctcctctttccttctttctccatgagacttggtcctaggttgagtcctatccctgtgcctcagtttccctgcctggggaatgaaaacagtcaagtaactcaagtagtaattgcaactgatgcctatgggggccatacattcttaagtgtctctcctgcttcctccagcctgatttttctggaaagggttattgttgggtaaagtggaaagtatgtagtccagggagccagtgtaactgtgtaagcgtaaccttgggcaagtcactcccactctgagcctcagcctgcctatttataagatgggggccgggcgcggtggctcacgcctgtaatcccagcactttgggaggccgaggcgggcggatcacgaggtcaggagatcgagaccatcctggctaacatggtgaaaccccatctctactaaaaatgcaaaaaaaaattagctgggcatggtggtggcaggcgcctgtagtcccagctactcgggaggctgaggcaggagaatggcgtgaacccgagaggcggagcttgcagtgagccgagatcgcgccactgcactccagcctgggcaacagagcgagactccgtctcaaaaaagaaaaaaaaaaagatgagggatgatattatctcacaagatgctgtgcagatgacacacaaaagtattttgcaaactggaaagtgctaatagaaatgttagtgaataataataataatcaaaataattaaaatagcagaagcctcattttctgtgtggtctcaatgacctgaagtgaattgagccctttgggtataaatgcagaacgatgtctgggaacatcctgcctcggtctttggagtgtagcctggattctcctgggaaagtgagaggctccatctggttgaggagggtgggaaagtggccctgccccaggggaggagtggggagggcttcagcctgggggaaggaaggaaagggagatggccagggaaggagagttgaactaagaggaacagagagagccttggccatgcagcccagagcctcctgcccacgggagcccacgattgggaaggctcagccagcaggggagactgagcctatttggaatcaaaatacttgaaggcaggcagtcaagaatctcttagcagctgtgcatctgaaacaataaatgcatctggtataactcctgagttttattggtcctttcactcattcatttaaataaatgtgtggtgagctaaactcaaacagagcaccttgtgtggcaaagtgacttgcccaaggccacggccccaggggcctgtgtgagactcccttgggagctcctgggaaaaagtgaatttgaaaggcctggggatgagaagtccaaaggcaaaggacaggatttgtacagaaggctgccaagcaggacactcgtccttctgtcagtcggcctgggcagatttgtctgtcttcccaccttctgtctggagggtgggcctgttctctaggactgggagaagctggcttcattctgctctctgctcttcatccgctgctgaacctggtgagcagggggagtgaaggcaccggaagctttgtctaaagacacctgatgaaggaggtttaagttggagaagagaaggcttgctttgggcatggtacaaagggacgcaattgtatcttgagttctctaaagggtgctgaggagagggcatagcctcattctttggaggccctagagtgcctatgaggacccagggtagaaggtcaccatgatggagcagcacactgggagggaggagttgggggagggaggtgcctggctctatagtgtgtgacaagcagagatggagagcccactggtgaggctgatactgagggaatcgcatcagggaaggatggagggctcagctcacatcgaggctgcttcccagcttggggcctctgtgcttcccagggcagtggattctgtggtaagaactatggccagcacatggtaggtacttaggaatgatgtgaagaatgaatgaatagttgtgtatgcctggaggtgagggtggtgactgggggttcgcggtcatatgggttgcagtggacccatggacagaaatctttggagatcatgctgcggttacccaccattctctctatgccttcgccatgaactagggaccctagagataggaacgtccagccctttcgtcatttgcaaatgaggcccagagcatggaacaacttgcccaagggtacttgctgagccagtggcagacctggactggaacccaggccctctccctcccagagtcctctgtggcttgaggtccccaccttcggattgtgtgagatggaggtgctgcagtggttggactggtttttttagtgggtaacagtgctcctggaggggaggagcatggcttaccttggttttgagccatgatctctgccacaagctgcttggccagcccctgccctttcctggagctcaggtgcacactcagcctgtgctcagacacatacagcaagtgcgcctgtacacaggccccatccccaataggtccctgggctctcactgttacacttactgtcattgtcaccaaggcgcatgtggacaaatgtacacatagacaccctctggacacactcagaggcacagaggattcccaggagacagttgtaatacctcctcccggtgggggaggacgccgagtcctaggcgggttctgccctgtcgctgtgctgcaggggtggtgaggggatccggctccggtgggatgggaggcccactgaggctgagtcaccccttctgagtcaggcatgcatccccctcttctctcctccccctccctttctcgctgatgagcccccaagagggcttggcgagagcaaggaggcccggggctggctaggaccagggtgggggcagccggggcgctcgagaggccccccagctgcacagtcccgcagtggtctgggaactgcccgtgtggcacggaccgggaggaggtggcctgggagcctgagagagagggcggggcgcggggggaggtgggtggtagaggagacaggcagagaggaggcggaggcaggggcagggccgcggcgcgctgggaggcaggcgcaagcggcggccgcccctgggctgggctccgaggccggggcgggggcgggggctggccgcgcgtcgggcgccaggcccggggctgtgggcaccgtgcccagcccctggcgcacgccgagccgccgccgccgccgccgctgctgcagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggtaggcacatgggggaatcaggtggctctcggggccgggggcttgcaacatctaggcccagcctccagccctggggaggaacgggggcgaggccgagaactgagttttcaggctgttggtcccctggccagtgtgggggagggtctcgctgttcctccctacctaccggtctgcagcctcctccaaggcctggagagaggatccggaggctgggggttggcggggggttggtcctgctgtaggatgagcggtgggtgggcgctgggctcccaccggctggcccagtctcttttcggagagcactcctgctgccgcctccagaggccaagggctctttggatttctgctgcttctgacgctgcaggaggagttcttggctggagcctgggatgctggcgagcccttgccctcatctctcctcactctggttacggacccttccccgctctgggcttgcctccccttccgtctcccttccaagtacctcagagctgctaggagggatcttagccctaggacttctgcagttctggcctggcattgtcctggccagtgaccgtcccctgatcagagggagagggcttgtgtgtcccacttgtgtctggcaccttcacacttggggaggtccaagggcccgagaggctggggtctcagggatgggcatggggggccaatgtctacagccattggggtacttactgggtgcagaggccactgactggcagacgtatatggctcaaagtggtccatggagaccttgaagtctggacaaggaccaaaagggagttctggggatgctggtctctccctcagctgccagccatcgtcgttgcttttccctcggagctctgaggatgcattggtgggggagagagcaccacgtgttcccacattcacttctggatccgcatagcacctcctctgcacccaaaggtgggaatgtgagacggccagatttaggacctctccagggctgtgcggggtccagcggcttggcttcattcccaccccatccccccaccctcagcattaggagccttccagaatcagtggcacttgagccaggtcaagatctggggcctggatggtgccctccgcagctcttggaagacagtgcctcctgtcccgggcaagggtgtggagaatagaggcagctgtgtgcctctctgcccacccattcctccagatggagcctgcggcagaggcagcctgtgccagcctcccctatgagccaccgtggcccaggaaggctctgccagctctgtgcaaggatggagctggcttctcctggccagcctgaggtcatgcctgcctggcaacccaggcatagtatttatggcatgcagagcacagtccctgggatttcaggggcacctcaaggcagtcctggaggagatcagtgcagagggcattgttcctattaaagcccttcctgggctatgtgacagtcctcctgggctcagccctgtgagcttcttgaagagcttcttccatagaatcctgcatgaaaacaatgcttggtcaggtagtcctcactcagtcgatattgaaaggttgaacggggcctagagagtaagagtgacttggccaaggtcacaaagcagctgagcgggggagtcagcattaatgtacccaggtcttccacctcttgttctggggctcttgcagctcaggtgctggcttccctgctgcggtggttgtgctatagacaggactctgccaagggctaggcattgtagcctggagcctgaggctacctgatcccttaggaggggtgttatgttggcctcccagcccttgccctcagtaggtgagcaggagaggtcagggctgagagaaagggccgtgggtggtcctggaccctcttggaagtgcatagagctgagaggatgccaggtgcccagggatgttctggcctgagcctccagggggcaacagagagttttctgacttcaggctgtggtgggaggtgcttgttagcacctgccgggacttccctaagagcccctttctgggcttctctgtcccatttgttaaaaggggacacaggcgtgcgccattgcgcacgcctgtaatcccagcactttgggaggacgaggcgggcagatcacaagttcaagagatgaagaccatcctggccaacatggtgaaaccccgtctctactaaaaatacaaaaattagctgggcgtggtagtgcacgcctatagccccagcaactcgggaggctgaggcaggagaatcgcctgaccccaggaggcagaggttgcagtgagccgacatcgtgccactgcactccagcctggagacagagcgagactccctctcaaagaaaaaaaaagggcggggaggatgatcatctctgcctggagataaataccaatgattacacaatcaaagtgatagtatttattgaaacttactgtatgccatgtactgcaagaagtgctttgagtcatttcacagtaaccctgtcagatagatgtgattaattatccactttttacagaggagaaactgaggctcagagaggttatgtcactggactaaagttacgcagctggaaagtgcgaggcggtctgagtccagagcccttctttctaccatgacatttactgggggcaatatctggaagtaccaggttggtgtccagtggagccaggcaattcattggtaggccagggccagtccaggtggagaggtgtgtgaggggtgtgtgtgtgtgtgcctggtgaggcaagggtggctttgtggactgaatattactatagtgctgaggggtaggggtagataagtactgactaggagctctcagagaaggattagccttggccttctccttcctggccagggtcccccagaagtggggaaacaccagactccctgctcccattggcttttagggaagatgggctggctctggacacatcccgaggccacagtggggactgggctaaggaggccctgtgggcagggagctgagccttggtggatgggtgggggtggagcaggctggcactgcttcctttgtgggctagaggcttgtggatcagaatagtaacagctaacatttattgagcatttattatgtgccaggcccagttttaagggcttccatgtacaactcatacgttcttcacaaagccctgtgaggtgtagatgaggtataggagttattcttcccgttttacagattgatggagctgtggcttagatagttgttcaaggtcaaatagctaggctgtgggggagtcaggattcaaacctaggcagtgtgggtcagagccatgttcctgaaggccatgccaggcagcctgtagtttctcagaggccatactctgttttgttcaagttgaaatagtcactcagtcagatgcatccctctcctcaaaggcctcccagtctagctgggagagatgcagacatgacacactaaaagtaaagagtgtgctattgcataggctcagcatggattcctattttggtgctcagggaaggcttcaagaagacggggacctttgagctgggcactgaaggccaagtcggatttcgatggttgaagggggaagggcacccacttccccaggtcagaggggaaggaaataggaatgcctctgaagaagagtgggcggtctgatgtgcgtggaacagatagtgtgtgtggcggagtgtgagctgggaggtgactcagaaagtcacctagtgtttgggtttttgatggagctctggaatccaccagacgtaggctatagtcacagcaatgcattgtattagccacgtggccttgggcacatcactcagctggcccaaacctcagtttcctcattcgtaaaatgcagataaacatgcctgtctcacagggaccatgttgtggttgttatataaagcacctagtgtaatgctaacacattgcaggaactcagtaaacattacttctctcccgcttctgtctctcttaaatgtcaggccaaggtgtttcgacttgacgtgagccgggatgctctaggaatctttgcaggattttagtctgctgaggagcatgacagaactgtgttttgggaaggtccttttggcaaccgtatgatccacaggagagggtggacgtgatcttacaggagaaaccttaactgtggggacttggagggctggggagggatcaagattggcactcattaaggtgtccctctggtagtgggtggttcgccaggttggagaaggaggagcttggagtgggtaaggccacagggtcaggaattctgtttcaggcctggtgagtttgagaagggctggtctccctttagtcatctggaagattgggtagcatcttttttgcacatctggcctgtttttcctttgaattatttcttttgaataaatccccatcagagcttcctctataatagcagtaaattgggactaagtgtccaacaataggaagatgattgggaaagctttggaacatccactggataaaataatacgcagtggtgaacacccacagaaaaactgcttgcagtggatggagctgtgcaattgcaaagctcttttgcatccttgattcattttgtgcttatgactgctctgcgacagaggtggggccggggctagatcctttctgtgtttgaagagaatgacgctagactccagtctccttgaaggcagagttgagttcacattttattcattgtttcgtcgcagcatgttgctcagtggtttgcaaatacttgtccgatgaaagaatgagtgaactaatcaagaggggaagtgacttgatcaaggtcactcaagttgtaagacatagtgcctgccatattcttgctattccctacttgccacattcttctcactaaccactcactatcttcgaggggaataggacagagaggttcccagtgaggacctggcacttgcatagaacagggtttaagtcttctttctgtttttactagctgtgaggcaattggcaagttaattaatctttcaaagccccagtttgcccagctgtaatgtggatagtccaagtacctggttttagggttgtcatcaagattgaataagttaaggcatgtaaacatcttggcatggtaactagtacatagtgaagtatccatgaacattagtggagatgatgatgatgtcatgatgtgatgtcattaatggtctgatacaattaatgttaaatgggaaagaagacccataagattatcagtattcatattacaatggtataaaattaggtatgaacatagatacagattggaagaaaacaggtagaaaatggagttccagcaagcatatgggaagtgaataaaacagaaaaacaaatatttctttactgttatatttacttttctttagttttaattacaaaaaaaatttgtggaaaatctaataattcagaagtgtaggccaggcacggtggctcatgcctataatcccagcactctgggaggctgaggcgggtagatcacctgaggtcaggagttcaagaccagcctggccaacatggtgaaaccccatttctactaaaaatacaaaaagttagccgggcatggtggctggcgcctgtaatcccagctactcaggaggctgaggcaagagaatctcttgcacccggaaggcagaggttgtggggcagtgagccgagattgcgccattgcactccagcctgggtgacagagcgagactccgtcacaaaaaaaaaaaagaaagaaagaaagaaaaaaagtgtattctccccttagatccccaaacaaatcctactctccagtcgtagctaataacagcatgttgtgtatccttccaggatattttctataccaacataaacatacaaaccagaatgggatcatacattgcattattgttttacaacttgcatttttcatgtaactacacattgacatctttttatgtcagtagatataaaatctatctcaaaaatttttgcaataggtatgttatactttcataattaaatttttaatggataaaccctactaatttggccagcccccctgttgattgacatttgaagttgtttccaattttacggtattctaagtaacgctaactgaactctaacagtatttagacaattagtgaaaatcaagtgagagaaggagtcagaaaccatgagaccgtgagagttgccctcaaaggtctgctgcttctcccttctcctgttccctcctctcctcactggagcctgggggaactggtcttggaggaggccatctctctgtcaccctcaaaaggtggtgatgtcccagggaaagaccctttctttcacccacccagtatggagctctcctaggaaattttcaaattctcttaggatgctctaagctgctgcttgggctgtgcagctgcccacacccagactgtccttggacaagctttctaccttctctgtacctcagtttgtccatctgtctggtggtgatcagagccattgctgccactgagtgtcttctatatgtcaaatactgtgctagagcaagcttcatgtgcattatctgtttttctattttttctttttattttattcttcttatttttttgtttgtttgttttttgggtttttttgttttgtttttgagatggagtcttgctgtgttgcccaggctggagtgcagtggcaggatctcagctcactgcaacctccgcctccccggttcaagcaattctcctgccttggcctcccaagtagctgggattacaggcacgtgccacctgcctggctagttcttgtatttttagtagagacaggttatcactgtgttggccaggctggtctcgaactcctgacctcaggtgatctgcctgcctcagcctcccaaagtgctgggattacaggcccagtcgttattcttgtttttttaaagacagcctgtcactctgtcacccaggctggagtgcagtggcatagtcacagctcactgtgacctcaaactcccaggctctagtgatcctcctgcctcagcctcctgagtagctgggactacaggtgcaccccaccatgcccggctaatttggggggggcacagggtaaagacagtgtctcgctctgttgcccagactgctctcaaactcctgggctcaagcaatcctccctccttggccttccaaagtgctgagattacaggcgtgagccaccacaccctgcctatctcatttaattctcactatacaccttggaggtgcaggggatagtcttctcaatagaggttaagtaacctgcccaaggtcaccaagcctgtggcatcaggattccagctctggctcataagcccatgtctgtaactgctgtttcctgcccactctcaacagtggctaattggtgaggtccaagcaaaatgattataaaaagatcctttaagttgtaaagtgccctgcatgtgggagggattgatactgccgttattatttctacatccagagcaacagtagctttggttatatggcttacagcaagttggaggtcgtgggatgtagcagcattgagtggggagagcactggactgtgagccagcagacttgagtcctagtcctggctctccttgaaactgactagccatgtggccttggccactaagccgcctgggaaataagctcacctactccgtgtggcccttgtgcagctcaaataagataaagcccaaaagacagccagcatgttgcccagctctcggaggataccctgctaacgggaggtctctctctgccttctgcatcgtcatcaggatgggccaggtgggacgcatgtctccgttttaatgctgttactctgcagttctgtgctgtcacgtggtccccagcccaccactgcacatcagcctgaggctccctagtggcccgtgaagcttttgggcaagaagccaaggctgatgggtggtggccttttcacattgtttggtctaaagtggtgtccgtgggtactgcaaacctctgacgaattgccgtctccccactgccatgtacaaatccaagcaccagacaggatgactgcagactcagctccctttttgatccttcttgcctggctgtgaaagtggcttgaggtctcagaggcagctctctcagcctgtaccctccatcctttcattcacgtccatgtagacattatcactcagggaagtgagtgttccatactggggaagtccccttgggaaggaagtcacatcatctccagcaagtgagagaaagaataagccctaataggcactctttctgtttttttttttttttcttgtaattcttcttttttcttttctgactccgaaagtaatacatgctcatagtagaaaattgaaaaatacggagaaaaaggcccctatttccttctccaagggaaggctattgttaacattttagtctttggacttaattggagagtaatatttctggagcaaatatttctaatattctggtatgtgtttagtgttttacaggcatgatctgattccattttcacagtaagcctgtgaggtatgtaagtttatcatcatgactttacagatgaagaaactgaggcacaaagaggttaaggggcttcctgacggttcccttgccttccttgacttcttagcttattctgcctcttctcaggctccccttatcctaagtgagcatcaggtggtggatcagtcagattctgacaggaaacagaattccactcagatgcttcacctgaggagatgttaataaagatgtgagcagggtgaggggaacccacatgggatggtgaggcacccacaaactaacagtgacagaaggcattactagctctcggcctgaatgagcaggagggagtggtgttacctgagttccgtgactggtagaggtgggcagggagctgtcgcagaggggctcagccaccaccaggaccacagagagagaaattggggaagatacacccaggatctctctccttccaccttctgaattcctgccagtgccttcttctttattattttttttttaagacagagtctctgtcgtccaggctagagtgcagtagcatgatcttggctcactgcaacttccacctcccaggtctgcctcagcctccctagtagctgggactacaggcgcctgccaccacacccagttaatttttatatttttagtagagacagggtttcaccttgttggccaggctggtctcaaactcctgaccccaagtcatccacccaccttggcctcccaaaatgctgggattgcaggcgtgagccactgtgcccggcccctgccagtgtcttctattggccaaatggaaccagaaaccaggaggcaagggagctcaagggacagtccaatgggccagcctcctgcttcttcaagcaggtcatggatctgggggtgcacatggagactaacaacccaagcgacatggttgtagggagatgggagagacatgtcctctgacttcccagaaagagttgtcttagtaactgactattaaaaacatcattcaaaacaagagactttttttctgcctgggagtctcttggtgttttggtgtctcctccctcccctgccccccatctcctctctcacctggttcagaatttccaagaacacctgggcaacagtctttggtgtcatcggtgtgcagggtttagaagagacaaccttgcttgcatgatacatgtggctgtgtgtgttctcatgttgtttcactgctgtgcctatgcatacaaagacatgcttcttgtgtacatgtcataagcatctataacatagtctcctctgtatccagcagaatattcactttttatttatttatttatctaattttatttttttgagatggagtcttgctctgtctccaggctggagttcagtggcatgatctcggctcatttcaacctctgctgccgaggttcaagcaattctcctgtctcaggctcccgagtagctgggactacaggagcctgccaccatgcccggctaatttttgtatttttagtagagatagggtttcacgatattggttaggctggtctcgaactcctgacctcaggtgatccacccgcctcaccctcccaaaatgctgggattacaggtgtgagccactgcgcctggctatttatttatttttgagacagaatctcgttctgtcacccaggctggagtgcagtggtgcgatctgagctcactacaacctctgcctcccagtttcaagcaattcttctgcctcagcctcccaggtagctgggattacaggcacgcaccaccacacttggctaatttttgtattttttctaggaacaaagtttcaccatgttggctgggttggtcttgaactcctggcctcaagtgatttgcctgcctcggcctcccaaagtgctgggattacaggcatgagccaccgcgcctggcccaggacattaacttttgtatctcaaagtcctcccattctctgtaatagccttgatctccatggccttcctctgatgtggacagggtctctcatccctgtttgacacatgaggaaacatgctcagaaagaggaagtggctgggtgtggtggctcacgcctgtaatcccagcactttggggggccaaggtgggtggatcacctgaggtcaggagttcaagaccagcctggccaacatggtgaaaccctgtctctactaaaaatacaaaaattagctgggcatggtggcatgcacctgtaatcttagctactcgggaggctgaggcaggagaattgcttgaaccagggaggcagaggttgcagtgagccaagattgtgccactgcactccagcctgggcgacagagcgagaatccatctcaaaaaagaagaaagaaagaggaagtgacctgcccaaagctgatcagatcggaagtggaagcactgaagcagcagtggtcccagttctgagttcagctcttcccagtatatttccttttcaatcttgggaagtctttctttagccagccccaaccctgggagaaatcagtacagcatgagccccctgaggttgctggaatgccatacagtgggaagaactctggagtcagagatacctggcacagccttatgactttggacaaatccatttgcctctttgcacgtgtgcatcctcattagtaaaatgaggagaataatatcaggactttggatggaaacatcaggtgttgagataaaataaatcatcaggagaggcaggctggctggtagccacaaaggctcccaaggtgaatgcagcccaggtctccatcctcagttgggtagactagaaattgtctctttgtgttctatccatcagttatccatgtgttcaaccttttatccatctacccctccatctgatgccaaatctgctgaatgtgaattctggcactgctgtttactagctgtgtgacctggagcaagttccttaacttttctgcttcagtttcttcttttgtaaaatagggataataagagtacctattacccattataggttattgtgaagatgaagtgagttcattgatgtaaagtactcagatcagcgcctagcaaatagcagactacaaatgataatgttgtttttatttatcaagaactgcgctgagccctggggataatggctaaccagacaaaattcttatctttatggagtttattttggaaggagggataaaaagaaataagtaaatcaatcaatgatagaagatcagtttgtgataattactgtgaaaaccgaccacccagctgggcgtggtgactcacacctgtaatcctagcactttgggaggccaaggcgagcagattggctgagcccaagaattcgaaacccaatctctactaaaatacaaaataattagctgggcgtggctgtgtgcacctgtagtcccacctactggggaggccaaggcaggagaattgcttgaacctgggaggtggaggttgcagtgagctgagatcatgccactgcactccagtctgggcaacagaacgagactgtctccaaaaaaaaagaaagagaaaaccaaccacccaacccagcatgcttgcttaatggattcgaagtttctgtttggggtgataagaatttttggaaatagatagtggtgatttttgcacaacattgtgaatgtaattaatgcctctgaattgttacccttaacaatggttaacaatggcaaaatgaaacaaaaacaaaacaatctagcatgctgtaaccaaaaaaacaggggaaaggacctaaataaattagacagggtggtcaaggggcacacagattcacaatctgaaggtgggagctgccaagctgtccatgcagagggaacattacagactatcattaaggacaaagccccaaagcctcgcacagtcgaagaacagacggaaagccaatgtgacaggctcatggtgatggtggcggcttggggagggaataggggaccagtagtggtgggagctgatgctgaatagatgggcaacagccatatacagaggtctgtagctttgataaagagtttgtgttttattttaatgggaggcccttgggggttttaaagagggcatctggctgggtgcagtgggtcacacctgtaatcccagcactttaggaggctgaggcgggcggattgcctgagctcaggagttcaagaccaccctgggcaacatggtgaaacccccatctctactaaaaatacaaaaattagctgggcatggtggcgggtgcctgtagtctcagctacttgggaggctgaggcaggagaattgcttgaatccaggaggtggaggttacagtgagccgaaatcatgccactgcactccagcctgggccatggagtgagactccatctccaataatattaataataataataataacaataataataaataataaataaagagggtgtccattgagagttttggaaagattcttatggctgctttgtggataataaactctaggagggcccaagtggtcacagggagaccatggagcaggctggggcagcccctggaacaagctgatagtggcttagatttaggcagttgcaatggtgatggagaaaagaagcaaatccaagttactggactcagagatgctgactcatgctaaccctggttagagggcctgatgtataaaccggacaccagttgattcattttttaaggagtggtttcactgccaggctgagtggatattgcctcatctgggctaggacaccctctccctgcaggccacccagataaacagccacaggtgagaaggctgctgagtgcccctggaaggtgagctagaggagccagaaggtggttagggtgttgaagagggtcagatgctgacagtgtgctgggccagccccagcccaggcaagcatccctggcctcactgggtccctttcccccagacagagtaagtacaggcgctgtcagcatttacttctctggctgacctttctcttttctaatcctgtgcattaggcctttcatatgttagtgtcatcagtctggccctgctggcctctgtctgttagaaacatctctttttccatttgttgtgggtggacacttctgaagtcccgttctcaggcccctcctcactgcagcttcccattactgctggtaattatagaccctacgtctcaggcttgttttattgggtgtataccatgttaagtgcttttttttttttttagatggagtcttcctctgttgacaggctggggtgcagtggcgcgatctcggctcactgcaacctccgactcccagttcaagccattctcctgcctcagcctcctgagtagctgggattacagcctcccgagtagctgggattacaggcacgtgccaccacgcccagctaatttttgtgtttttagtagagacagggtttcaccatgttggccaggatggtctccacctcctgaccttgtgatctgcccacctcagcctcctaaagtgctggtattacaggcgtgagccgccacactgggccactaagggctttctctgtgttattttcctaaatctccttcaccatcctgagagggagggaggagtgtctctgttttattaaacaggcaactcaaggccaggcatggtggctcacgcctgtaatcctagcactttgggaggccaaggcgggtggatcacaaagtcaggagttcgagaccaacctggccaagatggtgaaaccccgtctgtactaaaaatagaaaaattagctggctgcggtggcggtcacctgtaatcccagttactcgggaggctgaggtaggagaaattgcttgaacccaggaggcagaggttgcagtgagctgagatcgctacactctagtctgggtgacagagcaagactctgtctcaaaaaaaaaaaaaaaaaagtggcaactccggctcagaaaagtgaagtcacttgtccaaggtcacagagtgagcaagcattggcactaggctttggatctgggtctgcctgactccacagcctgtgctgtgaagcactgagccacagggccgcctgctctacctcccttcaagaggtccatgaatgactgtgtgaagtctctagccctgggcctggctggcagcaacgcttagtgttgggatctctgtccttctcctgcacagtgatgcttctgactcccagcaaggctcccagctccgtcactcctcccaagctccaaccagttcctccttccaggctgtttggtgctcacctttacaggcttctcactctgaagtgccagaatgtcaaggtctcctctctatcccctgcccaacccccttcttcccatctctgggcatttgcccacatggtgactcagctcaaatgctctccctgcatctcctgtctaaatggctcccttttttcaacacctaattccaccttcacctccccaccctagaagcttcctttgggaactctaggctatagtccagatcaccaggtccccagactctgctgagaggctgaaacatacatggcaaatctaaatcatctcctgcatgagtgtttagccatttcctgggtgagcatcctcttcccacactgcagccagctcctcgggaaccagcacgtgcttccctccaggggccactacagtgcctggcccagcctagccgcacagcaggctccatcagtctgtgctcacctgggcctgggcagaaccatgcccacgtgacgggctatgtcagaagccacggccacctaggctccctttctgtggcctagtgagagaaccatgctgttatccttggatttgtgaaataaagatttcatcatagatttttttttttaaagatgttatttttgatttataaatttttaaaaggtttaaacagattttatctccttctcatactgccataccaagccatgtgcctcagaaaaatttcttttttgacctctaacttaaactcattcaaggaatctccaagtatagtagcaaaaccaagaactacagttaaacagaagaaaaaataataatctgtcttcccgccacccagaaataactatagttaatactttgctgagttttctgtatctgtgcatgtgtattcattaacacagagataatctgtacaaactattgtgtatcatgctttttttactcaaatcttttccatgattttttacgtttttttccttaactctttagagtggataagccatcatttctctcactagcccctggccatggaatgcagaggtggctcctgccacgtccttggtgtctagcgtgaacctgagtactttctcctttggggggttctgttggggtttgcttgaggcagccaagtacagtggagagaaggcagacctagagttaggatctggggagtctggaggctggggagggaggagagtgggcggaggaaccagggaaacctggtttctgaggaaatgactgtcagtcgtcttttttgctcactgggtctcacctgtaaaggaagaggagtagattgaattatctcaaaaatgatctcaaaaggcatccagctcctctcctctgtcgttctgggagcgccaggcatttgctgccagcgggctctgctggagacccaggcagaggaagactgggatatttatttaaggttgctttcctggctatttcaaggaacctcaggcccaggaaaagttccgagagtgtgagctgaaatcagattgaggccatcggagagggaggagtggaagtgtctcccggctgtctgggcccacaaggggtcatgtggattctgcatctcacagcagaaaacacacagatgagtctgtgatgctttttttttttttctttttaagcaaaattaagtaggcagttattttaagggttcttgcctataggccttatctggcattatgaccagtatccttaagtgcaggctcagaaaagatcctgagcccggtgcaccggtatcatttggacccttccaaggctgtgggctcccctagagcagctctcattgctttgtatcctggcctggagtcagcactcattgtcctgtaagtgacagagagcctttatttaactatggctttacgttatacccataaagcagagagtagtggcttgagtggaaagcatttctgggtggggaggaggtgatggggacccaggccttcccttcctcctcatcttccttctaaatagcagcatcagtaacaacaaaccctctcatttgtactccaagcctccacgcaaaaagcctttccaccgttatccactctgtggggggctgaggatgttcagggccccagagctctcctgtgcctgagtgggatgctcagggtccctggctttctatccagtgctcttggctttgggctgggctgatgtccactgagatgcagggagaaaaactgaaaaatgaaaaggaagtgtggggcgggggacctggagcacgtggctagcccagggtggatgctgtgtctgtctgtctgtctatcagaggcctcccacgatggatggtgcaggggagagggcgtgccatgccagtctagcctgaatctctctcatgtaatatgatagatttagaggaagggcctggactcaggggtgagggttcctgctcatttctctatttccctggttttagcttcaaagcttttttttgaggatctgttgattgggggcaggaatgggtgcatctgatgcccctccgccaccctacctttctaaaaagccaacttgtacgtttaaaaaagtacgtatgtatattttatttatttattttaatttaattttatttttttgagatggagtctcactcttatcacccaggctggagtgcagtggctcagtgaaacctctgcctcctgggttcaagcgattctcctgcttcagcctccccagtagctgggattacaggcatgcatcaccacatccagctaatttttgtatttttagtagagacggggtttcaccatgttggccaggctagtctcgaactcctgacctcaggtgatctgcctgcctcggcctcccaaaatgctgggattataggcatgagccactgctcccggcttatgtatgcatattttaaaagataaaagtacttccaaaacatataaagtgaaaagtgaagttttctctcttatgtcacccagttcccagggatctctttcattttcctttacccacttctgccttaccaacctctcttaacattggtaagtatcctttcagaccttttactaaatgtgtgcaaacacaaacatatgttgttgaggttactgttttgtttttcttttttctttttcttttggagaaggagtctcacactgttgcccaggctagagtgcagtggtgcaatctcagcttactgcaacctccgcctcccaggttcaagcgattctcctgcctcagcctcctgagtagctgggattacagaagtgcgccaccacacctggctaatttttgtatttttagtagagacggggtttcaccatgttggccaggttgtcttgaactgccgaacttaggtgatccgccctccctggcctcccaaagtgctgagattacaagcatgagccaccgcgcctggcgtgttttgtttttcaaatataaaaatgagaccatgccattctctctctctctttctctctctgtaacttgcctattccagcagaatagctgggcaatgggtccttgactctctgaaatctcctcatttactgctgaaaggggaaaatgacaagaatagtttatcccagaaagcatttctctacgttgctcatgttttggatgagtctgagagaggtgaagtgactgccacatttgtggccaactcggggactgagcctgttcttttgacttttacatcgtcaagcctgcgcgtttttttgttttgttttgtttcaagtttcttcctgtcattctctttttggatctattctgtgaagttagcagggcaggaattattgaagcttggggtatgaagaggtgtgtccagcttcagcactggaaaggtctggaacccagggttcttttagttaaattctgtgcatccagctttgctgagggtctaccaagcgccaggtgaggtggctggagagacagcctggcttggaccctgcctggaggcggccactggcagccccgtgtgctcctggtagagcagggctccctggaaggactcatcatccctatgaaaggcccagagatttgagtccctgaagagctgcagacacagggtgggaggggtgcctgtgacttcagccactaacccctcacctcccatgaccctccctcctccccacttcctctgtctctcccttcctcctccctttgccctgtgactctttgtccgtttgcctccatctgtctctctccgcgtgtggttcctgcccctctcgctgtcataccattgctgtccctccctgtcacatgatctccttcatgccaatgcaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacaggtgtgtgcccgagagcatgggcgtacctttcctgcccagaccgtcctccaggtccagttcttagggctccagtattttttctggagggaggaaagaaggaaactaagatttattagtgacctgttacatgccaagcactgtgctgggagcattgttgttattttattttcttttttgagacagatctcactctgttgcccaggctggagtgcagcctcaatctcccaggctcaagcaatcctcccgcctcagcctcctgagtagcagggacaacaggcgtgcaccaccgcacctggctaattgttttaactttcttttttttttttaattgagttggagtctcgccctgtcacccaggctggagtgcagtggtgccactgcactcttcgctcactgtgacctctgccgcccgggttcaagcaattctcctgcctcagcctccttagtaactgggattacaggcatgcaccaccacgcctagctaatttatatatttttagtaaagacagagtctcaccatattggccaggctggtctcaaactcctgagctcaggtgatccacctgccttggactcccaaagtgctgggattacaggtgtgagccaccatgcctggccttttttttttttttttaactttcagtagagatgaggtcttgctatgctgcctagactggtctcaaactcctgggctcgagtgatcctcccaccttggcctcccaaagtgctgggattacaggtgtgagccaccatgcttggcccattgtggtcattttaaaattttattctctcagactaaagagggtagctactaactcccccattttacacctggggaaactgagcaccagcaggataaaatgagttatccaaagtcacattgccataaagtaacagaggtgaagacaaatctagatctgattttgaaggctgagttctttccatttattttcctacccctgaacctgtctgttctagcttggccagccccatgtaaccccagagcaaaacccattgccctaaagctacaacagactcacctcctcatctaattaacaccttccttaattcacgacaggcctggagggggcagggacttggccaagatcactgagggcatcagcagtggagttaggacccggggcgggcggcggtggggcaggtctctggcctttctcctctcctttaactcagtccacagctcccagactcctgctagatccagtgacagacaaaaagaaggagaccagatggatgctgtgatgagtcatgtgctgctctggggagacagggcagctctggccactggctttggtttcatgggatgctcctgcctcagaggatgcctatggcagcagtagcctgcagggaagatggggacccctcacacaaggccacccattatgcatggaagccctggctctcctcctgtacacaccagccatggaccctagttgccctgtgggtctcagacggtagcgactttcattctggggtctgtcttggccccagatgcctctatattgcttcttacttatatgaaaggccatggcttaaaactcactgagcaaactattcccttgcttggtcctgcagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggaggtaggggagcactgagtgccatatgtcccgtccccggtcagccagcctcaggtccagggcaggctcctgtgtgtacccagcttgggccaaaccagaggagtcctggaccagtcacagtgtccagagagatgacctggctcggagctcctttgtacagatggtggcaccaaagcctggagagagtggttatgattgcaaatagaattagacgaggtacagggctggcaccaggggaagattttgcagggtgactataccttggcaaggatgccaccatgtaagggctgatctacaaacagtagacctgggaactgggctcccctattcacccaggagagactgacatttaaattagaatcatttttatatactgggtggagagagggctcctcccttcctagtgaatgtccctgtccagggcaccatctcaagtctccaggacaaactagtcacctgagggttctatggcaagcccatcaccacgtcacagggaggcggcccattgggaagatgtcacccaggccatgtagaaaccctgtggtatggccctgccccatggtggtgacacagcagatgcctccttctgggtttggccctcctggcctcacatttaggtctccttttcctatataggttctgactcccgccctaattctgagctctcgctcgccccctctgtgagcccttagaggttctatccctgccgaggcagcattcgtggcccttctccgcatgtgtgaaagggctcagagggtgtccttgctactgagatatataggagctgcccccttttctctcccatgcactgattttagggatgtggcttactcctgagccctgggaggctgagtccctcttctctacagggttttgatttgttttgtttttatgtacatgtattttttcttttttttcttttttttttttttttgttgagacagagtcttgctctgttgcccaggctggtgtgcagtggtgcgatctcagctccctgcaacctcaatctcccaggttcaagcagttctcctgcttcagcctcctgaatagctgggattacaggtgcccgccaccacacccggctaatttttgtatttttagtagagacagggtttcaccatgttgcccaggctggtctcaaactcctggcctcaagtgatctgcctgccttggcctcccaaagtgctgggattacaggcatgagccactgcacccgactgtgtatgtattttgtctatagaaagatttcaccttccctgctcctgggacaaaggaaagggctgtcttctatgtcctctctcctaccttgatgggccccaagatgccatttctgcctgtcctagaagtgcacaaagcatttgactgaggctaggtcctctctctctgatgatctccaggttcaggaattccttgtcaggcttggtcccgagggcccagccagaccttacaggggtctcactccctctctagagtccctgcctctttgggtggtgactgcctcctgttcccctgccatgtgatccccttattggtgctcatctttacccctgtgggtttggagtgcccagtcgggttctcggcttcgtcattctgaatggtggttcagagaggcccaagcctagctctacaggagtgggaggaacctacctggccctaacaatggtacttccagcagaagctgatggaggccccatgagcctctgtgaaacctcactggctgtggggaagggagtggtgggctagcctgggctgccctggatttcactcagggaagggagggtcacactgtgaccctgagccccaagccctccccttctccccctgcccgcttctgtcatattccaggggcggcttctcttcctctcacacccaaagcttaggacttgcttttctgccccttcggtctaagttagcctccttctcctaatcactaaaaaggaaggagaaagccgtcacttcctatgccttccacttcagcttctccccaagcaagctcaaagtccagaaaccaccaccagaacttggaagaaggccatcaaggagctggccattgttgtcacccccaggatcccttaggactcagagggcagagccaagtgggtggcaggagcgctgcattcctgtccagacaccgaaaggcccttggggtttttgaattgtcctggtggagcccagggtatctcccagcctcgccccggggtgtgcttcagcctcatagctgctctgcttccctccttagaaacatggccggggccaggtgctgtttgacctggtctgtgaacacctcaacctcctagagaaggactacttcggcctgaccttctgtgatgctgacagccagaaggtacctgggctagggagcagggtgggacctgctcttccgttaggctcctgtaatcctggccacccccaacagcatccattagtgctcaaatcattaagcatcttctgtttgcgtgtccccaaggctcaaccagccctatccacctgcggttccctgtctcagccatttcttggtgacatacaggtcacccccagatgagaatttagagagccctggtctggctgctagagttgctgggggagctgaggagctccctgctagagcttctcccctacccttgggaggctctgagtttccttcttcctgccagtcccattgcagatgcatcacctgctcactgggactgcctcagggcagtggcagctccgggcactgggtccaagcctggtggtgaatcctggccccattcccctcaccccctagtcccaaggaaaaggaaccaagaggcttagccaaggaagggcgttccctacaaggggctgctgaccagccatttcaggatatttctctctctcagcccagtcaggtcctttcctgcgtcttccctctgaagatctctatcttttcttttagaactggctggacccctccaaggagatcaagaagcagatccggagtgagtggcttgttgtgtttggggaggtgggtgggtgaggggattccaggccatgagagccccccttgtactgctctctcctcctttggaaagtgcatttcaggccaggcgttgtggctcatccctgtaatcccaacactttgcgaggctaaggcgggtggatcacttgaggtcaggagttcaagaccatcctggccaacatgggaaaagcctgtccctactaaaaaaaaatacaaaaattagctgggcgtggtggcgggtgcttgtaatcccagctactcgggaggctgaggcactgggactgcctcaagcgattctcttggacctgggaggcagaggttgtggtgagctgagatcatgccactgcactccagcctgggcaacagagcaaaatttcatctcgaaaaaagaaaaaaaaaaaaaaagaaagaaaatgcattcagatccatgagtccgtgtactccacatggcagatcttgggagaagccagagtgggaaggacaagtctaaggcccagagaagagagacgactgtgcagagtcacacagcaggttagcagaggaatcataaatacattcaggacgccagctctagaagggacctgcagagccatctaggacaaaggacaagcagatgggctggaaacagccacccttctgtccaggaatggtgtagtcttcagtaaacaatgaccctttcctcagaggcccagagagaggcagttattacctaaggtcacagagccaaatgttggctgagccaggtcttgaggcctggtcttccaacaccatcctgtgctcttttcaaggcctggggtgaaggcagatgagcaggccaacaacctgtcctttctggcccagagagagaaagcatgtcgggaagggatggggcagctcccaaatggcagaagggggtggtaggtggcctcagcaaggcagcctgagtagttggagacctggcgcctcgaggcagagatgcctccacccagggcccctcccccttggctgtggttggtctctcctgaactccctggtcccctggctggaaagctgtagctgagcctgttaccatgacagcgggcagctgggcccagggatgccagctgactctgcaggagggggctcgaggaattcttcctgaaggttctgtcagttggagacaaagaggcaggcacacagacagagtgcactcctcggggggctgacagatcctccgcctgggcttcaggctgtcccccaggagccccagcctggctgggaggcctgtctctcatgactaaagggatcggaaaacatataggcagccgagtgtgtggtgtttggtcaggaccaggagcttgggaaagacaggtggctggaccaaatggtcaggtctcagcatccctcccagaggtggcctgcagcccctgccagcacagcccaggcctggtggatgtcactccttgtagccatcccaagtcatcgagtaagtcttgatcgctagcaagtaccttatccaggagagccacagtctctgcctctacccctgtaacttccagccatttatcctcatcctaccttctggtgccccagtggagcaattttttgccctctgtgacagcacctcagccttctgaaggtggtcccattggtccttgtggcctgagcttcagagttgggtgtatctcctcccaaacctcagtgcacctggggcaaggtagggcaaagtagggcacctgggacaagctttccacccctctgggcccctgcttctccttggccagtggattagtagttcctgcctcatgaagtgggggtgacagttcaatgacatatgtatggacagcaccaagcacatagtaggtgctcagtagctgttttcttcttgcttccctgaggcaatctggtgtgatggttaagcagacagacactgaggccagactgcctggatttgaatgttaactccacctgcttcttgtgttgactgtgccttggtttcctcctctgtaaagcagggtagtgctagtacttatatttatgttgttgtgagggttaaatgagtattacatgtagaatggtgcctgcacacagtagcacccagtatgattagctattatttatttttattattattattgattattaccattattattcctgaggtaggaattcctgagaccattgttattcattgaagctgctctttccaaggagtcggtgtggtcaggagcctgggctctggggccagatggccagagttaggatccccattctctaccactgactagctgagtgaccctgagagagtgacataacctctcagaattcatctataaaaaagaaagtcaacttcaggatgattatgaagatcaaacccctgtacatgtgcataaagttcttagcaagcacagtgactggcatctagtaagagtttgagatgtgacatctgtatggtgcagatggtggttaccgcagagacaaggatggtagtgatgatgtggcctccagtggtccatgaccacagccctgccatggatgggcctcgctttctcactttgtcaggggccattttgagcctggaacctgaaatgttccaggggtgggtggtctgaccattgttgtggatatgtagactttcgctaattttgtccagtacctcatatctacctgccttcatcccctctcaagtgaccaccccttctctgggcttgcagagcttgcttccagctataacctcagcctttattcccctgtgtatcttcttagatgtgtgccattggtttttcacatctaagtgtggaggttagcatttatccccctaaaatatccctttgttacatttagcccattatatttaccttttaggtcttgtttataatccaatcctgtcttctggtcttgtttataatccaatcctgtcttctgagatggagtcaacatgatatagggcagagttttccaacatgtgttctgagaaacattaatctttcaggatgctctgtgaaaaatggatacaacagatcaaatcatttttggaaattcttgaatgcatgttcccctcagagagttgcagtgcacagtagcagggtgagggctctgacaagtccaaatttaggaaacctgtttaatgtattatctagacttttttcttatcattaacatcctgcaacccagactaggttgtagaccaaggagccaggtggcctgggtttgaaccccagcattgccacttccaagcagggtgaccttgggctaatttactgcctgggcctcagtgtcttcatctataaaatggggctaatcataggacttactcatggggttgtggtgaggtttactgaagtaatgtttgtaaagcaattaacagtgtgcctggcatgcagcgtcagttttctttctttctttctttctaccttccttcctactgctagctcacgagtctcttaacttgggcctcagtttgctaatctgtcaaatgggaataatgttccagccttcctgattggattgtcctgagattatacataggagaaactttgaaaaactgcccagaggatggtgcatctggaccacccagtggggtgttagggcctcgctgatctctctcccatctcctctcaggtagcccctggaattttgccttcacagtcaagttctacccgcctgatcctgcccagctgacagaagacatcacaaggtgagggctgtggagggagagacaggtgtgctggctgtgtgggactatggatgagggaccctggccctggggacacaggcagtatgtgacagcagctgcaaatgcagtcgcctaccgaggtcaggcagacagcatcgtacacaggaagccgactcattgtaagaaacacagtgatgcaagcacagtggtcagtggcagctgacccttgatgtcagaggaggaggtatcacagggaactgtggggccttttgtagatttaagaggacagaagccacctaaaacagttgctgttcccctccgggccatcactgtcatgtaggaattgggcctgattgttgaaatgaacctagagattaaagaataaaaaccacagttctaaatgttggcaacaaatgcaaactttaaaaaaacatagcatgggccatctctgggtgggacataccaaacccatgtaaaagctgctgtgctgggtgagccaccagtttgcagcattgggagtatggagagggtagaatgggatgcctttgaacgtagaactttggtctgcatgccactctgtgcacacatcaggcacatggaagtcaagtggggcttaggactccccacagagaaaagcctgggctgttggggcaagcgtggactgtgtgtgcagtctcgttgtgcctcagggccagtagataacatggcctgaagattggaaatgagtgcaaagcatccttcaggatgagagcttccgtggggttatcccatttctggaaaccagaacgggggaagcccttctcttaagccctttccaaagagatagtctcacttcatgatatcctggggctgtgtcatccaggtgatgggccttatactcccaacataaaatatgggcttggagttcccctacagcaggggaagggctcctaagccagcccctctctcccattgggtccctccttcatcttcatgttgattgcgtgtttgccaggccatcgaccaaaggtcaaggtgctgactctggccttgggagataagacagatgttcctggaacagatcaggcctgggctttggcgtcattagtcctagttctgagccctgaggtcaggtgcgggctaatgtggcagcagcaagatctgaaactccattcccaagtggactgtgtaggttaggccagcacagcctcaatccccctggtcttccctactgatacctctcctgtttgtgccagacactgggcactgtgcttccagggacaccaggaaggaagttaggcctgcctagcacagatggccccaggagatgggtgctatagcagctgatttcgccaaaaatagttaggcccgaaataaactggtcaaaatgacaaattgattgaaatgaaagattggtcagaatatttggcagtgatttctgaattttgagacttttgaacagaatgcccataagcctgtactcggtgcctgtgatgtttgagctgctactgattctgagtctatgccttggccctgggcgcacactgaggctgcacatactttttgccaggacttcagttctgactgtgaaataatgtcaccaagtagtaagaattattttaagtaaaagatacttaaaagaaaaaagcccagatatggtggctcacacctgtaatcccagtactttgggagacaatggcaggaagattgcttgagaccaggagtttgagaccagtctgggcaacgtggcgaaaccttgtctccacaaaaaatacaaaaattagctgggcgtggtggcatgtggctgtaatcccagctactcaggaggctgagacaggagaatcgcttgaacctgagaggcagaggttgcagtgagctgagatcgtgccactgcactccagcctgggtgacagagtgagactccatctcaaaaaaagaaaaaaagaaaaagaaataggcagttgaaaaaaaatggtgaaacataacaaaaatggacagggaggcatcgttggctaaaaatgaaacttttttttaatacatagtaaccaaaaaagcaataaaaatggttttaaatggttctaaaattgtaaaatcgtccaactgtgcataaaagttataaaaaatcatggcctggtagttggaaatgtttctttaaaccaatttgttttcagacaatttacttagagctggaggcaaaataagaaagttttgggaaagcattggcaagcaggttcatctgggacatggaatacaatgtggaagttaaaatgaatggggtagagtcacatgtgctgacatgggagggctctaaggcctgggtatgaaaaagtgagctgttagaatcagagacagcatttgatgccatttacaggtaagaaacacccataaatcaaaaccacatacatttctggtcatcaagaggaaatttagagtcacctctaaagtgtgaatttttccacaacatgaatacagtatattacttgtataattaaaactatacgacattttgtaatggacaaaccagcaaagtagtcctatttagcttgaaattgagttagaaattgaaaatgctgtcataatagaaaacaaatccctcaaatttagaaatgcacaaaaatgcttaaagtcatgtgaaatgttgcaaaaccatctcatgagacatacccagattgtcaatatatgaagcgccaatgtctacaaacacacttttctgctgagctatgttctatttagttctgatggacagctgtgcttgggggatctagggaggagtagggccctgtgcccatgctggctctcccctatctccagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatataggtaagagggtgccagccagggccttctgtggctccttggccagtgggagccttccttgcaggcctgaatgtcctaggccgccacatactgtgctgtttgtaccccgcctggctctgcccctagcttgaggtatatctaagagcaaatcatctctgtaaataggaacgatagtgactggctgtgtggccttgatgaccttttgggacccaagtttcttaagctcctctataggtgtgataattccctgtccttggcctctgagaataagtttatctgccaactggagaaaataatcgctactgtgtctctgagtaagtgtcctcatgtctagatcttggtgtagagttcaaaagtttggacccgaaagccagcctgctagggttcctatactggctctgccactttctaactagaggatctcaggaaggtcatttcacttcctatgctttggtttcctcatctgttcaaggtggatgctgttaaacccaccctgtaggattgttgggaagcctaaatagcacatattaaaggcacactgcatgttggctgttagtgttgctgtctgtggatcgaggggttgaacagttgatcatgcaggggaaagtacctcgttccagcagttggacgataattaactagtgtgattgtaggctggttatttaacctatctaagccccatttttcacctgtatatgcacaaagttagattatcagtgtctctcaactattggcatttggggcaggagaattcattgtgcagaatgttcagcatccctgggacccagtaaatgcccataacaccttctcagtccttgtaacaacccagatactcccctttgccattgcttctgtacaggttcccctggagaggagcccttggaactaaatgatttgtagggtccttttaagctggaagtatttggggctgtaagtccaggattgttatggggactcaatataattaataatgtgaaggtgcattataaactgtaaagtgcggcacccagggaaaggagtatggtgatattgtctcattactattgaggatggagggaattaggaggccttggttctgtgggcgttatctggagaggagggctagagtcagatgtggagggatcgtgtacgtggggaagagcctgctggggtgtgatgaatgctaggtcaagggtggcaaatgctgtctctgagagtcgcacactaactccacttggttaatagcgactgctgtggtgttgtgttgagtaggacactgattccctacaatgcccaggttagcaatatccacctgggcataggaatagggagtagtggcctgcctgccatctatttgtcatccctgtcctagatagcaagacatcttaggatttgcaagagtcataataattcagagaaagatgttcagatcaatatgggctggagaaatactaagggctgtccctaaagctctttggacctaaagcacactgacatctcgtgtccaagtatcccacacagcagcccagaggtagacaggtcacaggaaactgaggcctggaggatacacaagacctgtaatgaagtgattaggagcataaactctgaagtcacattgtctagattcaaattctgactcttcttcatagcagtgtgaccttggacaagttactcaatgtctctgtgccggttttttcatctgtaaaatgacaataataataatacctatcttacagagttgttatgaggattcagtgagttaatatgtgtaaagtgcttagaacagtaaccagcacatagtactcaataaatgtttgctgtgactaagtataaaatgtagtccaagtttcctggcagccaaagcaaagaaggaacttgattaattacataactcttctttttggaaaggagaatgtgcacctgttccttaggagagattaagtggcttctgatactaaattctgcaagaaatatcctgtgtgggtaataatttaggagcccctgggtgatgataatgaacaatgtccgtaacaatggttttacagtcatggaaaagtagaatttatagctcacagtcaactcagtggcagaatgaggcaaaaatcctgactcccagctcagcctttgtatgatccctggactaacaagactggacttgagctttggcagaagttgggggttgggtgggctgaagtgggagttggggtacaccctcctgctctgagggcagagggaaaagattagggtgaggctcagcatatttgactttctagaatcatgggttctgatggtgggcacctttggacagcaggactaaacctgggcctttcccttggtcacctgtgatcactttctttccctcagggggatgaccccgggagaagcagaaatccacttcttagagaatgccaagaagctttccatgtacggagtagacctgcaccatgccaaggtaccaccagcttcctgggttcccctagtgtctgggtggtgcccccaaagaactatcaggcctttccctagggcgtggtgtgccagaccctgtgttacctccaacttgaaaccttttctgttctcattctcatttctcgaagttccataaccttttattttctcatgatctgtattattttctccatgtattttatttatgaacctgtttgagccactgctagattgggagcattgtgagggaaagacgtaggccttagtttatttctatatccctagcacctggcacatagcctggcaccaagtgtgtgccactaaatatttgctggatgaatgaacgattgagtgattgacagagcaaatgatcaaacaagtgagtgggtgaaaaaaatacctaaatggatgagtgaatgactgaatgactatgggagggattggtcagtgggactccagcatggaggctctaaccctgttcctgagagctcgttacaagcagcgcacagggcagtgttttcggggtgggtggtaggctgtccccaggcatggaccccgggcctcccattccatggtctcttctcatgcaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggaggtgagtctgccttgggaaacactcctcctcaccggaatcaactagaatggagtggaccctggcagctgggcctggactgccaacacacacacacacacacacacacacacacacacacacacacacacacacacacacacacagagagagagagagagagagagagagaggagtctaaataaaagtataaccacatatggccaggtgcagtggctcatgcctgtaattccagcactttagaaggccgaggaaggtggatcacatgaggtcaggagtgtgagaccagcctggccaacatggtgaaaccccgtctctactaaaaatacaaaattagctggcactgcactccagcctgggcaacagagcaagactctgtctcaaaaaaaaaaaaaagggagaaaaaaaaaagaagaaatataactacatacattcaggtcacacagataaatgaatacatgtctgtgtaaagttcatgtatttaggtgttgtaagtatggaagtttgtacacattttaagatacacagactcgactatacatacaacacacacaaatgcaaacatgtatatgtctacacctcttttccttcaattacctacatctcacccatcaaaaagcccatttggttgtacctgtagaataaacatgaacccatttgcttctcttcctctccatcacacccgcctccagcatcccccatcttttgcctgtgcctatgagggccttctccctcgcctctggtgctctccaggtcattttcctcatagctgctggagagatcttaaaaagtcccttaaatcagatcatggcaagcccactcccccttcccatccacacccttgcttacacctttcaggaactctctttagctcttgagctaaacttcaaactccttccatggccacctacctctcccacctatcccttgccacactgccccatgcccaaggtgctttagcctcttcggccttgagatctttgaataagtcgagctctttcctgcctgagtgcttcgcatttgatgtttcctttacctgaaagtatctccccctctcgcttctcacatagctggttccttcccattcttcaaatgtcagctcaagatcacctagatctaggtctagaggggatcccctgctcttccttagatgacaggagcccctatgccttcccagttctgctgcaccacacatctcccttcattccccttgtagccctgatcagtgtctgcaattatcttgtttgcttatttgttattggaggtccccttcccctactagaatcttctgccttggtctccatgtatctctagtgtttagcactggacccgtcacagagtaagggctcaatcacccttattgattcagtgaatgaacaggccaaagtcgcagatgcctgagaagagttcagaaagaatgactcacgtctgtaatcccagcattttgggaggctgaggtgggaggactgcttgagcccaggagttggagaccagcctaggcaacatagtgagactcattctctacaaaaaattagctggtgtggtgtcgtctgactgtagtcctggctacttgggaggctgaggcaggaggatctcttgagcccaggaattcaaggttacagtgagctatgattgcgccactgtactccaccctgggcaaatgatcgagaccctgtgtctcaaaaaaacattaaacaaataaaataaaaaacacaaagaatgggctagtggcgagagtgagctcaggccctgcctctaacctgcccttttggttttccagtatgagcaatttgagagcacaattggctttaagctcccaaaccaccggtcagccaagagactgtggaaggtctgcatcgagcatcatacattcttccggtgagcctgaccttggatggggtaatggggatggggcagaggccatgtgtatggaggggagcagggggaggagttagtgagaactctaggaaagtcctccaccctttccccaagtccctcccttcctggaccactttgaattgttgtagttggtggagtagtgggatgaaaggccagctgtggtctaaccttgggcctggcagtgcaggtctgattcctcctcctcccctgcatccctctgctgcaggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggaggtatggcccaaattggagggctgggcggggaatggtcttcagagggaactgggggagtgggcatgctgggttctgcagaatgagcaggaaaatggtagatgcatcccaagttcatctgcaccaggctggcccctcaagaccagtgctgtccctgggcagctcttggtggcttagtcccaacctagagctcactcccacttgagatgtgatactaccactctctggattccccacaacttccctgagtcgtggtcttttggggtcccaggtttagccatatggtttgggccacctacccaagaagcttagcaatccaccagtctaacctgtggtctaaccttgggcctggcagtgcaggtctgattcaccctcctcccctgcatccctctgctgcaggctggtgtcccttacactggtcatcatcatactaggagaatagtgtcttatgactgcagtgtggagctgatgatgccttatctgctgggaggccagggcatcgttcttggtcattcttttggttctactaggttctgggctgattgacaatctaaccacatggcactctccactgtccccatttctattggattgatgggtgcccttaacatcaatgaaaactggccctatatagtcctgtagcaagcagatagggcttaaaatgtggtgcacaaaccacgtttcatcagagtcgcctgtgagattgttaagcaagcacgaaaattcccaggttttgccccagacctactaaatcagcacccttcagggcccaagtctctccccaggatgtacacactagagtttgtaggtgatgttcggaagtcacatgggtcactggggagattcagaattatgcagatctgagttcaaatctcggcttgacagtcaccgtgggctgttctctggacactggaagtggttcataaatatctgaatgaatggatgggtgaccttaagcaacttatttaactccctgagcctatttcctcttctacaaaatacatagtacctactttgctgtgttctagggaaaactaaatgagatcatgcctagaaaatattctgtggcacatagtagcaccttaagaaattgtacccatcattattgtttttaggtttgtagagagtggcttaaaggtgggaagtgggggctgggcatggtgactcatgcctgtaatcccagcactttgggaggccaaggcgggcagatcacctgaggtcaggagttcgagaccagcctgaccaatatgatgaaaccccatctctactaaaaatacaaaaattagccgggcgtggtggcatgcacctgtaatctcagctactcgggaggctgaaacaggagaattgcttggacctgggaggcagaggttgcagtgagctcacaccattgcattccagcctgggcaacaaagcgagactccatctcaaaaaaaataaaaaaaataaaaaataaaaaggccaggcacagtggctcacacctataatcccaacacttcgggaagccaaggcaggtggatcacgaggtccagagatcaagaccatcctggccaacatggtgaaacctcgtctctactaaaaatacaaagattagccaggcatggtggcaggcgcctgtagtcccagctactcgggagctcaggcaggagaatcacttgaacccgggagatgaaggttgcagtgagccaagattgcaccgccactgtactctagcctggtgacagagcaagactccgtctcaaaaaaaaaaaaaaaaaaaaaaaggtggaaagtggggacttgggtagggaaaccgtggatactcccagaacaccttggggcaggcctccaggcaagttagttctacttatattttctgagtgttatatgtgtgccaggccttgtgttgggtcctgggtatagtatttagagtgaataggtttggtcctttcctttgaggagctcatagaatagcaggtttgtaagcatttgttgtggttcaagcaatgggaaaagcatgtgtagaatgtagagtagccatgaggagggaggaattaagtctagaagggacagaaatggctctgcagaaagggtgccaactgggcagggtttggaaggatacctaggagtttgccaggtgattaagaaagtctgatactttgtctggtatatgaaaatgagacctgtctcaggactcctgtgcatgtttgaaagatgtgtagttctgctagggttcatctgaggctgaagaagctccttcttctccttgggtagacagaggactgacaactggggtttatgcaaagggaaaggtccctcccctgtagcttccattactatgtcaggagccaaatgaagcccagattctggcaggcagcagaggttagcccagagctggtgaagctcatcggagaggagcagaagcatggactctaagctaggaggccttggtccctgtcccaactcaccaaaaggtcaccagtgggatatttcccctcttgatgtctccagtcatcctctgtaaaatggggataagtcagtcccattccagccatcaacatagggtattgtgtaaatcaaacgaaatatatgcataaatgcgtactttgcaaagtgagtgtatatgaatagaaaggataattatcctcttttaaaaatctaggccaaccccaaggataatctgagctctggttattttaaacccgtgtttttcagcctattttctaccaagacacaatccacgggcatagtcggattatgcccaatgcgtgatgcgaagtctagttccaccccttcctttcctattcagaaaagcattttggaataccagtgagtgagaaaggtgttattgcaggcatctccctgaattctccctaatttataaagaaggtaaatcagttgcaaattttaggactttagctttcactagtaaagctagtctcacaatatttgtgtgttgctaaatgatgatcaagtgagtattctaccacaaccaccacaaccaaaacagcaacatttatgggctgccattgatggaagcctcactctgtgccagccactcttccataaatatttatatacattagcttgttcattcctcacctccgctttctaaagcaggcactgcttctagatgaggaaaccaagacccagcaatattatgtaacttacccaaggtcacacagtcaagaacagatggatttgagatttgaacccaggctctagtgctgtagaaaccaggaaggagtcctgggctgggaggcagctctgccactcactggccatgtgatcagaagtctacttcacccctctgggcaatgggtgaggggtgtggaagagttggctccactccaggcgtggttgggcagggctgggctggttctctgtctgttctctgggaggggtctcacatggttgcctggctatctccacccacttcagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaaggtaggagcctggctttctcatactctctgccctggggatcaggaggctgacctgaggtctagcctcggccttgaccttcacatgcctccagctgtggccaagcacccttactatggagtgcaccatggcagggccttgcctttgggtcatctctcaatacctggcccttgccgggatggggtgggcatgggagtgggcatgctgcctgtcctgtactctccccagctttgccctgcttttccagaggggcactctgtcccctagaggactcaggcctccttttgcacactcttaatttgcccctctgactgggatctggatctgcaccactctcttcctcctcagagcatgaccaggtgtcaccaacagctctaggagtgtgaggttcaagtgtgtccccttcctatttccccatgccccactcaggtgcacacacacagtcccagtatctgtgtgtacacgctcatgcaggattgcatgacctcagcctcacactcacttaataacagatgtatgcacccgtcacccttagatccatgcacacagatgtgcaaacaacatgcacacacacaggtgtgtgcacacacaggccagggagagcttcctcttggtatagttgttcagcaggtttctttccgtctaccttgtgagcacagggccttgaacatgctcccactgacagcgagagcagggaactccattctcacatcccatctgcccagtgtggctctgcccacttggcctctagttcccttctctgccttcctgggacagcaccctgcttcacacctgtaccttcttctgactacctcactgccctgctggtggcccacccagctgccctggcctccacttggtcgagtgtgcgtgctctgggctccttgctggaccaagcccatcgtggtatctctaatccatctgctctactgaccctgctgctttctttccctcctaccacatcccactagccggagcaggaaaccacgccgagacacaagcaggaggtactgcatgggacctgtccctccctacccagccgttcccatccctagctcatttgtcaccatcccacagtccatcccaggctcacttccctggcaccatctcagcttcaacttcatctctgctccccagccatccccctctgcagccgtccttgctccccactccgccacccgctaagcttctctctccagctcccttcttagactctcctggccaatcggccatctctccctcctccctcagccctcccaccctctccccagctcacccggtcctccatacttgcagctcacctgctgaccatcccacctgcaccaccagctcttccaggccattctgtgctttcatttagcacatctcccctgacccaccccttccctagattcatctcctgcccgacagcactgtttggtctcgcctccatctcgtctgtgtcccctgtgtcctcacccctagcttctttttgtatctattggcagtcagatgtgggagtggggattgggggtgggggagggaggtgcctcagagcacacctgcatctgccccaactccagtcctacacctcccccaggcagggtcgactactgctccgctatggcaaaaacctcctccttttctcctcctttcctcgtcttcttcccatttgttgcttcccccaaattattccttccatgttaaccacttcttccctctcacacagtcaccaactcttcatctgaactttaactgcaagagaagtgggtttattcttgggctgccaaggtaaagggccagagactgggacataagaagagccttgccttggagtcctgagatctgggtttcaaccccacttctgccaccaactctttgaaggtcttgggaaattcccctcaggccccagtcccctgtctgaacagcaaagcattcagactaggtttctccaatgcccttaacctttagggatcccaggaccccaggatcccactgctccctacagccttcagggacataacacacccacggaggcagtggggcaggtttgtgatggaagacgacaagccacatctcaggttgggactcactacccattgcagcccaaaccctctccctgtgcaagcaccatcaggtttgacttctcagacagccatggtccagagggcagctcagcttgggaagggatgcccgaggaacagacagatgtctggagggaaagcaggagcctcactgggattggtttccttcctgaggtagcttaggagtcagccatagtggatccttgggtaccagagatgagcccaggggaagattctagctttgtccaagggtaagcttaccttccagtggttcttccagaattacctgatctgactttaataagctgagattgtccatttcttgtcctgaattgagttaacatgaatttttaagcagccttgcagataagcgtccttgggctgccagccaccactttgccccagaagtagccagataaacagcttttggcaggtccctgccagctcctgcacaaagctcgtcctcccttgacctaaggagatgactctgtcatgctgcactggctgggaacactacccatataggtagaatcctacaactctggctatacctggctcaattcttgtgcccagctgtgggacttactgctcttcttcctggtctctaattctcctaatcttcctgaacactccacagcattctagtttctctatctggctgtatctcaccctgtctgctattggtgagtcagtacctgaaaggtatctggaaggtccagggtggttggggaaggtagtgtcccatcacagaggagactagatgcaattttttcctgcccctggtccctagtgtgggagcttggccattcttctggatgtccctggcttgaggaggatctgtactgtgggcctccccagggcctgagcagttgtgcatgttgggctaggaggggcccagactggacatcctgttaagtacagtggcccaagtctcagccagaaagtggacactgggatccaggagggatctaggaggcacctgaatgagtcagagcagcccagtgaataggattagtgagttattatagctctctggcagttgctgcctgctatgccttagttgtaacagagggaagtcacctctgtgactaagaccgggcttatagcaccacagggaactcacccagacctgtgggctttgggtagaggttggctgttcagaggctgtagagccaggcaagggagaagcgaaggtggcttgactagacatctcctctttttcatcttcagtgctctgtgccttgggatgtgcacctgttggggtggttctccttgccctggtttgtctctggggctgccatgagagtgacacaggtcagagtgggaataacgttgctggtggagggtggtgatggtgactgctgccatcatccctgcaccctgcatccccgcttggagctgttcccctaacaccaccaccctctccatctatccctagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgaggtaggtgtcgccctgaacccctcgataggggccttgggtaaagagacattgggttgctgcatcctgacttacactcatcctccacaccaatatgcttcccccattgctgcttaggggctggtggggatggagagggtggtagattaggctgagggagatgaattcactaaatcttggaatcctgggtcctggagaccaacttaaaacatgaaaaactcaagactcatggtagcttggcgtactccccttccatcagcccgagtataatggggaaggggtgctggttagaaatgcaggtttcagggccccagcccagacctactgaatcagatatttggactcagtgctggcatcggcatctggacaagtgctgcagaggcttttcatgcacactacattttgagaatcccaatagctctctccagaaccagaccctgttgtgcctattgtgaaaacacggatcggggagtggtccctcctagaaggggcttcggagtccactggaggggaatgggcccttcacagaaatcagacctgcttctgaggcttcagaaaaggatctcacatgacctgcctttccgagtggaaagagtggggtgttttctcgattgaagaagagataaagttaggatttggggaagcactgcatttagactctcaagtcagtatttttagcccttgctaaatcttggcgatatttaccccagtttatacttaggtgttttctccctgaagctattgcttactggtctcaaatacggttgtggtgtagacttgcactgcctgggtttgaattctggctccgctgcctgccagctggatgactttgggcttgttacttaacctctctgaggctcgttgggtagagataataaaagcacctacttcatggggatgttgtaaggattaaacgagataatgcacgtagagggactagcagagtaccttgatgcgcagtgtgagttattgtttcacttgagagttccagactcttccacagaggaggttaacttcaaatcaggataaagaaagcatgtttcaatccaaagtgttaaagtcaagcatactaatttaactagaggcattcacagacgacttttctttaacaaataaaattcccctttcctaaataaaataaaagttgaaagggccctgggaacctgctcagaaccttcattttacagataggggcaccgagacccagaaagaggaaggacttattcagtgtcttagctgatggaagaggaaccagaacccaattttcttgtgacccaggctattgtatgtgctattaaatcacagctgcctaggagcaagaccaaatcacataaagaccaggtagagagtcaattgtatgtgtgctgccctctaatgctttgaaaattggtgatgcacccatgatctaattagcagagcattttattggatcagtgctaccatggcctgaacctgccagataacagacggctttgtctagtaaggcataagtccagagagagctactggggtggctttctggtttgtgagtcacagaattagggatgctttgggggcctttaaggctggtgctgtggaagaagggcagacctctgcatccatgaagggcctctgtttgcctctggcacaagcaagaccctgggctgggtggcggaggctggtctagtgatccagtgaacaacatcctcttctgcccttcagcgtggcccctaatcaatcctgatgtgggctggccaagcttggcctggctgtgggcgaggtgggatgcagaggctactgaaagagtgagtctccagaagagaaggggaggatgagccctgggaagtgaggtctagacctctggagtgtctcagtgtagcctggtgtagggtgtgccccacctgctggtgatagctggaactgctagaagatgggtcttagtaaaaggtggaatctgctccacctcccagccctgctcagccgcaagaagtatagtccactgctggaaagaactatggtccaggagctcaccctggagctatggaccattcagaactggcttacaggcccccttggcatttaggggcctttgaagatttgggagatggggaggtgccatagacaaggattgactggctccttgggtaacttcccctttttgagccgcattgcctagtccacctacaggaggaccaaaatggtcattccatagggtagttgggaaagtagagtgaaataattaatataaaagcactttctcaactggaaggtgctgggcagtcatggggctgttgctgttggtgactagaatccctgatcccaaaatcagttttgtggggggcatcctgaagatgcctgtgtcatccagaattcctagcagcctcctcgtatattgttgggcctcatctgggccaaggggaaaacagagggaactctaactgttcccatttgccaaacccaagtttcagtgtttaaagggggctgtaatccaaactgcagggttgaaccatagcctaagccagagacatctggagccagagtctaaatgatatggctccaacatctctgaatgagagtgggcaggccatgggggaagggcactggggctgactgtgggcctccctcccttaagtggctcagaagggcagtccctcccgagctcaccccacagagtggctactccctgacctaatccacaaatcctacagatatgggacttaaaaagctgggctatttatggactttgtgtgtgtgtctctctctcctactttttctctttccctctcttcctgtctctgtctctccttcccttcctccctctttccctttcctctggctctgggcctcccctgcagtcccagaggacccaggacatctctcagcgggacttggtacctgagcctggagcagccgcaggcttggaagtgttcactcagaaaagcctcgcagcatctcctgaggttactgtcttcaccttcctgtgccccttcctcctgcccacccagaaccaccctctgtggtcttaagaaaaccctttctctggggtgaggggaatgtaccagattctgccaagcagttggaagcaatgggtaacccatgctgtctccatgctgtgataaggaaatgtccccatcccagagatccataaagggccagcccctccctcatccattgtttctcaggagggacaggactgcaaccattctgggaagacagaacagcctgcattgcctttggcctcgaaggagaggcaggaatgatctccctctttcaggtcctggtgaggcaggtgactctagaggcaggccctgacttctatgcttagggtcaggggtcatgctagaggcaggctctgacttccatgcttagggtcaggggtcatgctagaagcaggctctgacttctatgcttagggtcaggggtcatggcacccaaatgccttctgccttaaggtcttttctctgttcagaagcctgaatggtctagcagtggttagttagggcacgacattccaggcatctccggcctgcgtcttctctgaactcccctggagcttgggcccatcaaggaggcaggcaaaagtggacatctttctctaaggagtatccttagggttgtagagagattggtcaggcaagtgtttgaaatgaggaggccattgcttctatgcccagggcggcagcaagtggagggctctttgaacttcctgtggcccttcatggatgctgggcatagaatccaggcccaggcaggaggctgtgctccctcctctgatgggattttatggactatcagggttggaagctactgagcgatcatctgggcagaactttcttccccaatatctgccgctcccctgttgatgtatgctctcctctgagggcctgtacctttctccattctcagagaaaacttctttagctgctgcaaacgtgctggaactttaagaaagacataaatgagctacataagtgataaaacataagtcatacttctactctatgaatttttcctcaatctaaagaacaaaactatccgcacactctcttgagggaaatcggacaagagtcaacagcataccaaggacagggctagagagatgccctggacacagagatgctcctgtgaccaaggacaggtgcccatttggggagcagagcccacaacctgcaccccgcccccgcatcattctcctgcaaatgtccatccagctcttccacagcaggcacttttgctgtccttggcggcagcccattaactattgggaagttttcgtgttgaattgaaatctgccttttcaaattagcagcctgtaggtctcattctgcccgctggtgcccgctaccgctctgcatcctcctccaggccagcccttcggagacttgaacacctccccttccctagaacacttcactctcttcccactttctcccaggaaatggtttctggagggccccttaccctggaccccctcctcgtataaagggcaggcctggctgggcatggtggctcacgcctgtaattccagcactttgggagactgagttgggtggatcacctgaggtcaggagttcgagaccagcctggccaaaatggtgaaaccctgtctctactaaaaatacaaataataataataataataataataagctgggcgtggtggcgcgtgcctgtaatcctagctactggggaggctgaggcaggagaatcgcttgaactcgggaggcggctgtcagtgaggcaagatcacgcctctgcactccagcctggaagacagagcaaaactccgtctcaaaaaaaaaaaaaaaaaaaaggcaggccccaaaatgtgacccagagctccaggaggggcctgaacagcctggagtcaggagaacagccaggctggagagtttcctgtctgtgccttgggtgcagacagctgtgagcccaactggctctgtttctccccacccctgttgccagcttcctttgctgcagtgcccctacctgacggcagggggcgctctgagcaaggcaccgacggtcccctggctccagaaagaatggctgcggggctgcggctacctggggctaccctaagattatcccatcttgtgattcgggttagaacgactttcacgccaacccctcgggccaggtgtgtggctctacccgtgccttcgcaccgtggaagtttttttcttttttgttcagttttcttttcctcttcaggatcctacattttactttgtcccccgctgctcagcctgtgatcttgcgcatggcctctcccctctgggataccgtttcgccttctgaaataaggataacgatatctgcttcacaagttgccatttggattaaatttaataactcagacaaagggctggcattgcctggcacatagcaactaacaatcactatacgtttcccctttcttcctgcagagtctacttttcattctctgccagcacctgcgccactcactcttgcttatctagcctagttgctagttagaattggggcaggaatgttccagaaggaggcatattgactggctttggccatcattgccaggcggatgtcagtacagctggaatggaggcagctgaaggaacctgcttctcaaggaaatgagcaaaaggacctagcttccgtaggctctcaaagcacgtccctttgggatggttcaggagctgtggtcctgaagccttaatgacctgaagtaaaagctcagaaacccaccccagactttacctagaccttccccccttccttttatctcgctttcccatgaacaagattattttaatgggttctgattccctgacagagagattttctcaaaacacagtggggacagagggtttatgatgctctcttgagccttcaaaatgtttcagatcttatgggatctgacagactcctcctccctgtggggtgggattaacagactcctcaccaagtcataacctgaaaaggagcccaaggtcatataaaccttccccctcctgctgccaggagaagttctgggcatgtctccctgtggaggtggtcatggtagggtggagaggacacacttcacagaacttggcgtcagagactgagttcaaggcctgcctttccacttgctccctgtatggccttgggcaagatgcttctccaggtctgagtttccatatctgtatcacgaggggctctagttggggcagtgaggagggaggtacctcagggcattaaggccgcccacacccccaactttaccagggcagctctgtatttctgtcacatagccgacttgcattaaaattttgtgggaagtatcctgtggccacaagatgaaaaacccagtgaccttcctgcttttctaaccaccctagaagtccatcatccctcccaggcattgtttgaagaactcttgggggaggtagaggctgttgggagatggcctaacagtgctgcgatctggtgcttttttttttttttttttttttttttgagatggagttttgctcttgttgcccaggctagatagagtgcattggtgcgatctcggctcaccgcaacctctgccccgcaggtccaagcaattctcctgcctcagcctcccaaagtgctgggattacaggtgtgagccaccgcgcctggcctttcttttttttagacggagtctcgctctgtcaccaggctggagtgcagtggcacagtctcggctcactgcaacctccgcctcccagattaaagcaattctcctgcctcagcctcccaagtagctgggattacaggtgcatgccaccatgtctggctaattttttgtatttttagtagggatggggtttcaccatgttggccaggatggtcttgatctcttgacctcatgatctgccagcctcagcctcccaaagtgctgggattacaggcgtgagccaccgcgcttggcctctggtgcctttgatgcacgatgatgcttagatctttacctctctcccttccttgatgcattctattgagttcttttctgctctttctatgggttttgttagaattagaatgggccctggtatttgtttcttttagattgaacaccacagtgttcaagctgtttaagccattgtggtgcctggcactaacgtggtcatgtggtatctccatgactactatgctttcttcccagaagcccttgtagaaaggttcgatttcaggctgtggcctgtggaacttaatgcatcccttcaatttgccattaggtcacagttggcacccatattccatggttgtgaaataagttagcaaagatctccggcctcaaaaatcaggctttcttttcctgactctgtcttctactaacagtgaccttgggcaagtcactgtccatctctagacctgtttcctcatttacacaatatggaaatgagactggataacattgtaagagtacttttgactctaacattcaaagactccatgtgatggaaatgactttcccctctgacggtggcagttatgttattaaaagaggaagaggaagggtcctggcccatctgtggatctccatttccccatggctgacatgggaagggcataagaccccatcccattttatcaagttgggggcagtggttgaggaaaattggtcaataatttatcaagtgcctgatgggaagagggaccttgatgagaatggctggcacgtcatgccttcctctccccagccagttctggggatgtgctgtcccaaagtcaaacatttcagtggtagattggtcccctcttacaaagggaaaaactcacccattcttcaggtacctgatatttcatgttaactcttcttgctccaattgaaacacagggttcagagcattgggtatttatagaaagagagtacactaggccagaagagctcggtctcctaaaagtgaccaccatgcagcaggaagaaaggcaggcaggccttgctggtatccttgccaacggcagactctccaaggtagacgttctggtggacaagttcaaagtggaagtggccacagaagaaatggtgggaaacagaagagcaaacacccagcaacaaggaaaaatgattgcaagtcctgaagactttgagtcagtgggggaggaaggcccctggatcagggaaagcccaggaggggctgccctggcttccggccgcacattggcagaaaagctcctcgagggctctgagctcagggcagacaccagagaggcaaccatcaggaaccgctgcatgtcagatggtcagccggagggccagacagagctgaggaaggggctggaggagcctcacacttgtgggagacccactgctccagggaccaggccagcagaggtggacgtcctctctccagcctccgacaagggaggactccagtcgtttctattggatccagcccacgcagaagccagagctgagttgagcaatgaaactgatacttcctttgcagagaggagcttctatttaaattatgaagaaaaagactcagaagaccaagtcctccctccacccctggaggagagaaaagggcgcctggatgcccctcccggaggtgagcccaggccgacgctgaattccttagacctgagggtttctgctgctgcttccagcaggagcaaggacgaagcccacatgacttccccaaaggaaggggcagggacccccaagaaccatggaggacctggtgacctgaagggatctcccgcaggacagacgtttgctgaaggctgggaagatgcccagtggggagtggaaggagagtttccccacctgacagccagcgcagcccgagaggaagggacccccgtgagtggagatttgctgggaaaggctgaggaaagtcccacagaggaactgaagaagcaccctcctcacagaggacagggcgtgcatcccgacccccaggcctgcgcccttcctcgggccatccctctgaatgtcaggaagccagtcaaaccagacagaggcaacttcccacccaaagagaggggagtggttcccacccagaaaggaggggctgagctgaaggaccgcgaggcttcagcatttcttcacatggaggtgatcattcccctgccagcctcccctggtcattctgaggacctggcagctctggaggaagcttctccaagcccaacctcccatgggtcaggggagccttcggagctcagggagccctttcttagacatgtccatctttcgaaagccagcccagagcccaaggaccaagtagggtttgtggtgtcccctgccacaggaggtgagcgcaggcctcctcccatcaccagcagaaagcccagagtagtccctgaagaagctgaggggcgcatacctctggggtttgggttcccttcagggaagcgaagggagatgacctctttccaggctggggaccaagagggctccctagaagatattagcaagacctcagtggccaacaaaattcggatatttgagacccacggagctgaaactcgccgaatgagtgagggtgaagcaaggtcccttccaaatgacgtatcttcagaggcacccgtgggacaagcagagcagcagcggagtacgctctcagacctgggcttcgcccaactccagcccccaggggactttgccagccccaaagccacacattccacagtgatacctctggctaccagacacttcagggaggacacttctgcatcctaccaggaagcacacacggaactagagcccgtgtcccccaattcaggctgtgaaaccacgctggcagaagctactggaactggggtaactggccgcgtgagcccccgcccccaccgctgctccccgcccatgggggctggccgcatgctctgtagtttttagaagcatgtttcagtggcccctcgtcatttctgcaatcagaggctgcttatccatccctgtgagttttttccctaaacgggcctgggtgtagctcaggctgaatgatgggcttctctgcttggcccatgttagcttggccacaaagaccctcagcttttggtgtgacctggtgcccagagggtcacacaacccccatggagaaggtggcgccaccaccagcaaatgacacacctgctttgccttgccgctcatacccgctgggttcctgcctaccttgcttggcttgtccagcgatctttcttcatcctttcccatccctggttctcccgccttgggaaagttgacagtccagaggtttccatccttcacttctggttccctctcagtcccagtgccaagtttctttctgcctccttaagactaactgtcttctctaatccagaacaaatccggagatgcggtcagggaagagaagcgctccaccaacttagcagccaacacccctgggaagggggggcgcctgagatttgccagcccctcgggccctcaggtctctgcagcccctctgtgccctgatgacccagtcaccttcacccggccaggatgcatcgccgccttaggttcccacctgctgtggcagcacctctcgtgctgctcaactctggcttgtctggaatgtctccctcacacctctcaaccttccagaaactggctaaatggaggctcgcttagcaagtgaatgtctaagcccactgaatccctagaaccagaagccaagttctttacaaatctttcatgggtattaggttggtctttaaaaagaatgttatgaaccagccaaaaatgtgtgtgtggtgtttaatccctgacaggccagttgagaggtatgtatgtcggacaagagttgctggttccccgaggcactgccttggcccgctgttgtcaattacactgatgggaccagagcctctactccctgacttgcctgtggtccactcatggagcccagggtggagctggcgtagcactcagctcccaagaagctcgtgcccaaaaggcctgaccctgaattgctcttctctctagtcgatgctgacccctcccccggagactcagtggaattgacaaacatgttggcttcctcttttgttcctcaaagttcttggctccaacctctctgccttcccttcctgggtctccctgaatccctggatctccctccttagtttctgtttctcaacgcccacctgcacggatgggcctggggtccgggcttccatccctgcctttcgtgcaatgctgcttccaataagctcccagatccaatacccttggatggagcctcctgtccaggagtcactggcaggacgtttgctttgtacttgcttttgccatcagtgtgagaccctcagaaaggggcatctccactcttgagtcgtttttgttttttttatgcttgttatgatttcaaggaacctttcctggggtgtttttcatttcctggcctgctcttccattcaggatgtcgacacagccccgagatttctcctgacattcaccatcttgatttctctttctctctctctccccaccccacatccccattcttttgattttatctggccatagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgaggtacagtggagcttcctcaagagccaggcccgctgggcaccgcatgctcagagggccctgggccacccgtgagaagaccgagcacccagcctgcagcctgaagctctgtctcgtgttgcatgactgcccctccgcagaacagcatggttctgtgctcgcatgtttgccatctcggtttacccctaacacgcgctccttggtattttaaccctgtgaccccatcgcttgctgaagtcgagcgatgacaggtagtctggtctttcttgaccccatgcccccccacctgtgttgcatggcacctgcagagagcatgcgtctgtggactcttgggggctcctgcagcctggtctgaaagctgaatggtttttcctgatccgggcccaggcttgtctctctggggtctgggcttcccggggaaggggaagcagtttaaatccatctggccctggggtctcagggtggtaatggaagctcctggaagagaggaaatgtggtcattgaggagggacagactgtctctgggcctctctgtggtctcctctgtagagctgtgaagggatttctctaaggcacgcctgcccatatcattcctttgccccctcatctcttctagacccaacctccctcctacactctcctttccccaacattcctggcattgaaatatgagcttagccactctgggctctcacttcatgctatattctctgagcaggtttttttttctccctttcggtgccttacaaacctatcatgttccaggaccaagttcaaatgtcagtttcctagcaggggtttgctttcctgaccaccctgggcagaaatatcgcccccctacccccttgccctgtaatgcctatgctccagcactatccaaagcggtcaggtcagtggctgacaagcctgctctcccaccaggtggcagctcctctaggcctggcatatactaggcactaatagatgattaactggatgaatggctgggttacagggttgcaaccatctataagaatccccttcagccaggcacagtggcttgtgcctgtaatcccagctactcaggagctgaggcaagaaggcagggggatcacttgagcccaggagttcgaggctacagtgagctttgatcgtgccactgcactccagcccgggcgacagagtgagaccttgtctcttaaaaacaaaacaaaacaagaaaaaaaaaatctccaggcacagtggttcacacctgtaatcccagcactttgggaggctgaggcaggtggatcacctgaggtcaggagttcaagaccaccctgaccaacatggtgaaaccttgtctctactaaaaatacaaaaattagctgggcgtggtggcacccacctgtaatcccaactactcgggaggcaggagaatcacttgaactcaggaggcagaggttgcagtgagctgagatcacgccattacactccagcctgggcaacggaacgagattccatctcaaaaaacaaaacaaaaacaaaaacaaaactatactcagaggtcatagtcacagcttgccatacccaaatggaccccacatgctctctacttcaccccagtcctcaacaaaccctcttcactcattgacatctcctgcctggatgctgtaggcctccaagcatgtgtggctcttgctctaaagaagagtccaggctgggcacggtggcccacacctgtaatcccagcactttgggaggctgaggcaggtggatcacttgaggtcaggggttcaagaacagcctggccaacatggtgaaaccccgtctctactaaaaatacaaaagttagccgggtgtggtggcatgagcctgtagtgccagctacctgggaggctgaggtaggggaatcgcttgaacctggaaggcagaggttacagtgagccgagatcgcaccatcgcactccagcctgggcgacaaagggagagtctgtctcaagaaaaaaaatagaagagttcagctgaagcggctgagaggtggtgagctcaccaggatttggtgacattatgtacacaaggaaaacacttagcccagggcctgtcatagagtatgttaatgaaatggtagatgttctaatagtagcctaaaaaacagcatatagccaccatgagggtgtgtggcacaggggcgcagggcaggcctgcctggtcctggtggtggtcctggctctcctcgcgggctatctgtctatgatatcacaccacaactcttttaccctgtccagagtacccttccagagatgtggccagctgtggggataggagatagcctgcagacaccacactgcaattgtctgtgagcaagggtcatgctagggtttcagttacagagcattctccctccttttcctacagcccgtgaaaacagaaaccatgactgtcagcagtctggccattagaaagaagattgagccggaggccgtactgcagaccagagtctccgctatggataacacccaggtaacttgtgccttccaatgtaccctaagcatgggtattgggcatttggtggtagggtccccactgctgtggccaaaccccttggccagctcttttaatctcagcttccctggaacccatatgttaatcctgatgctctcctgtgcctcagtgtcctctctgagctctggggaggggcaacgggtaaagcaggttcctgtcctgggcagaccatacttcttaaagcctccatttagccatccataaaatgggaatgaccctgtctaccccttcctcctgggcatattgggaggactgtactgactagtggattgggaccttggtgttcacattgcttggaggagttggagaggtttcttgaggtatctcaggggctgcttgaggagagaagagggagagatcccaattcagcttcagtcagaatagctcaccttgggtcattttttatgcattagagttccacatcagatcagtaaaatgaacaaagtgaaagaagaaaaccgaagatcatgtgtcttgacaagaagcagcatcctgaccacctggagaaagccgtcaggcataggcacaggcccacgacttccagtccattccctgcactccttccatgctttttaaacttaggaagttaagattgaggatctgatagatgccctcctggtttttcctggccagaagagctacaatgctaggagcttttttgctctgagactaaccttttcctgaagaactgaaataagaccaggcacagtggctcacatctgtaatcccagcactttgtgaggccaaggcaggcagatcgcttgagcccaggggtacaagaccagcctgggcaatatagggagaccccagctctacaaaaaatacaaaaattagctgggcatggtagcacatgcctgtagtcccagctgctcgggaggctgatgtaggaggatcactaaaacccaggaggtcgaagctgcagtgaactatgagctatgattccaccactgcattccagcttgggtgacagggaaaaaaagagagagaaagagaaaactgaaataagacataaaccaatacaacatgggcaattcttttgtttccagatttctttctcccacttttataatgatggtaggagtttatgaggccgtctactacaggtcaggactcttgagttctgatgagctgtgtgaccttgggcaagctgcttcccccactgacctgttttgttttagtaacacgtgtttctgttgtgttttcatacagaaaagtataaagaaactaaaattggccctagatcccacagcccagtaacccttattgacataaaaacaaaacaacaaaaaaagtttatagttatacaattcaagcagaacaaaatgggatttttcttataatatcacccagaaaaaaatataagcctatttcaacacagatacctacatctctatatacttaacaatgtttacacagaagtgatcattttcttacaacttacctttcttcttagtaattattttggagatcactccttgttggcatacatagacccaccttactcttgatcatctcagttaggaggcaaatcttgatttatttcgctgtctcccaatggctcgccctgtgattgtttttgttttgtgcaattcactatcagcgctcgtgaatttccttgctcatacttctcggtgagcttttcaaaggttatatccaaagagtcagttcctagagattgctaggtcaaagattacacgcattgcaatttggatagaatttgccagatagtctgagattattttttatttaccaaatacactggttgaaatgtaatgagggcctgttgcacctctgtgatttggtctgtgtgcagccccctgccagtgatgttcactcacacagcctgtcactttgtaactgggaggccgtgagcccaggtgacagatgctgcaggtatacccagctctccccagctctaacgactcctcctctggtcagcaggttgatgggagtgcctcagtggggagggagttcatagcaaccactccctccatcaccacggagaccatatcgaccaccatggtaagttgaacccaggaggcttccctctctgaccagccccctgccccaccaaacagccagagaacaagctaacatcgcctggctgcttcaggaagttgtgagctgccctcgctgcatcaggcatgggacataagtcagctgtttattatctggggctttagttgccacaggacatagtcaggcctcagttttccaaagtgagtaatgtgggcgatggaatccccactgatagtgtcagttatctaggccatctcagccacagcagagagagagagaggatggtcttctttggttattggcacccacgaatctcatcttgcattgagatttcattggctcatctcacctccactctgaaggtgaggctggacccatcctggtggctgcacattgtctcatgccttagaccacttccttgccttggtcagtagatggcgtgtggtgaccctaagttggaaccaggatttttgggacctccctattgagggacctcatggttctgctacttatttgctgtctgacccatgaaggaaggcccttggcctgaggtgtcctcatctgcaaaatggcaataatccccattctgcagttcttaagagaccccggcaacactagatcccttcatgattaaacagaacagatagcatttggcacacaggttgtggttccagtcaatgtgctgagactcctgagtggataatctccgtggatgctcacagacactgtgaggtggatgctcttccctccacaacctttatagatgaggtaactgaagttcagagaggtaaagcgacttacccaaggtcacacaatcaataagtggtagtgccaggttatccccaggccttctgacaccaggagccccactttcaaccccagccactctgctctgcttccttaatcctgaccattgtgaacatcagccgcatggggctggggctgcggttgcagccactactcgggctagggaaggtagcagtgctggagccagagaagttgttttcaaatactgtttcttgccaacctcctgacatacacataggaaggtaattccatcaatctagactagccagcaggtaggttttgaatacacagaaattttaaaatcaataagtccaaactagttaccagcttgcacacctttccctggtcactcagttcctcctctcccctcagtccttcaccacgtgtcattgggatgcttgtagggctaaatttaaatccgttcatatggtgagcaggcacttataccattcatttactcatccatccatccatctattcattcatttgttccaaaaacatttattagtctgtactatctgcctggtatgggggatacagttgaagaaactatactgcctgctggaattcattcattcaaatgaccatcatgagcacctttaatgtgctgtgaccctgtatttaggttctgggcatacagcggagaacaaggcccagctgtcccacttcctggctggatgaccttgggcaagtcacccgaacctctccaaacctcagttttcacttctgtaaaatgggtgagggtagagggcagtaatagcatgacctcaaagggctgatgtgagggggaacgaaagcaatctgtgcaaagccctgagaacagtgcctggcgcataataagtggcctgaagatgtgagctgcagttacttctttcctgccttcatgggacagtgtaataatgctatcctaggggccaccaggaggacagctatggggtgacagctctgccaggaggagccaggaaaggctttccctaggcagggacatttgagtgagctatgcttgaaggataaattaaagtatggtcctgggggaaggcattctagacagtgggaaaagcaagtgcaaagggcagaagggaaggagtgcagcatttggggaaggaccagtggtcaagaaagccagatgtcaagcacacggaggaggagtcgggggggaagagctggaaaggaaggctaggccagagcttgatagacctcaaatgtcatataccaagttcaaacttctgtcctgcagacaatggggaatcacttaaattttttacattagggacatgatgtcatcagatatgtgtttctgtgttttagaaagattattctagcaacctctgtggaggagggacttgagcaaaaaattcttccctccttctctctctctccttccttccacaaatattgattgaacacccatgatgtgtatagttctgtaccagccactgtgaatccagcttgaagaagggaacatcccggggctctagggcccacatgccactgggagagacagagagagaaggcagggaaccagcttagatgctggtgcccaggctggggtggggctggagtgcaaggaggtggatgcagagaaggggtcagggttaagggatgcctggaggggggaaagcacaggatttggtcgttggtaggatgttcaggggacaagaggaaagatgagctcgtgacaccgttcactagccaatggttctcaaaatgtggttccaggaacctgttagcaaggcaggtcctttgggctcctccttagacctattgactcggaaactctagggtggggcccagcagtgtgtgtttttccaagccctccagctgatgcctctgaagttggagaactgctgatgtaaacagagtgatgggggaaagtgctctttagtgacaagcgtgtgttggaagtggaagaagcagtgaattcctttcgagatcggatgagtctgaggtgcctgtggaacatttccagggcaaaatgtctaggacacaactggttttaaaggcctagggtccaataaatatctgggctataggtgaagggataggggactttgacctccatgaggcagcagaagctgttgagtagccgaggtggcccagagagcgggtggcaagtgaggagagcctgaatgtggaggaagagagggctgagtttgccttggtcagggagaggaaccactcctcctggaggcaggtgacgggactggccaaggatacaggagaggaagggaggagcagagggtgcctcgttttgaatgactgatgtccctagtggtggcctctgtttttagtgtgaaggtggaggtgaggctttgccctgggaaagacagaacaatgagagaataagaggctttaagggagaacttcccagaatgatgctaggattcataggggttagtggctgttaaggggaaaggaagcattgagcccggaagctgcccttgggaagcctgctgctgggccacattctggaactgcaggtgcatctgggaacgtgccttgtggtgcagtaccaaggaaccaggctgctggcagcctcagcaggatgcaggtgtgggagcggcaggggaaagtcagcgagtttcttttctcacctgtcccttggtaggcagaagtccagatctagtgccatgcctggaccagaatcagaggtcaggccactgaggacctgcagaatggacacagttctgggcccctggacagacaaggctgagccctgagatggtgcagaaagtaggaggtagaagcaggcagctgggccctggcgccagatcgggggcagtaagtcaggggacaattccaggaagatctagcaattagaatttaaggtagggccaagagagctgtctgaagggaaagattcccaagggcagagtggcgtgcacagtgtgttggacttggagtcagacaacatggagttaagttccagctctaccactaacttgctgggagactgaactcttaagtttctcttgccctccagtttctcatctgtaaatcaggaatattaaaaataatgcccaactggtgttatgagaattaaacgagatgaggcatgtaacatccttaaaatgatgcctcgcacatagcaagcactcagaaagtcattattattattatattctaaatagccagcttatgcccctatatttatcctatgtattttggtttgcaaaaccttttctactccattagcttcataggttctgtgtgggattggggcaagggtccttttttacagatgaatctgtgaggcccatagagaggaagtggctctgccccaagtcacatggcttgaaggtggcagggcaggacacgagcctgaatctggcaactcctctgctagtgcttccggagaacaatgccatgtcttgatcactacagtgttcctaacgccagacagtctgtaaatgtttgttgaatgagcgagtgtgcaagtgtgcgagtgaacaaatgtgtgcctgagtgagcaagggatgaatgaggcggaactgaacgatgccttcagtcctttgcttctattatttctactcaaccttgtggtcgtgatagctacatggccacatgctccgcccatcctgggggcccacccggctgagagctggccatctgagcactattgtttccccaggagaacagtctcaagtccgggaagggggcagctgccatgatcccaggcccacagacggtggccacggaaatccgttctctttctccggtaagtgggcaaggccagctcaggctaggggactccacactgagaatatgggcatggacccatgtatggctggcaggaagtgcagcgttgagcccagaaggcacccttctaggtgcaaagccaggaaactggacccttttcagatgcccacagggctccctggtgcctgctagaatctcatgagtggccctccccaccgcccacacatgtaagtggggcattggtgacatgtgagggtaaagcggcccctcaccttggtggtgctgctgagggttcttttgcatctgccctccctactaaccaggaagagcaatggactaggaggccagaggcttggattctggacctgcctctgttggtgcctgcccagtgaccctgagtctgtcactgtagggtctctttcagctcttgcattctccaagtctgtggttctcattgtttagctccgcagagagcgtgcacctggctatgacaggatggggcatcaggagggctgtgtttccaccttggatccttttggtcattcttccatgatgccaggattcttaaattctagggtattgttaggattctgggcctcaggaatcttagcgtctaggaatctcagactccaggatttgagaatttgatgggtctagttttctgaagattctagtattcttgaattcttaatggctgaaagcatcttggcttcgaaacgtcaccttcacagagccctttaccccaccccgccctcacccctccagagcccactgtccttacctgacaccctgggtggggggtggttatattctgcagatcatcgggaaagatgtcctcaccagcacctacggcgccactgcggaaaccctctcaacctccaccaccacccatgtcaccaaagtgagtagcagcagggcgccccatgcccccagccgagctgcaggcgagaaggtcatgactgttgttctgcttcggcttcgccatctgtaaagtggacagagaaaacctgtagtgtttaccagcttctggaatactgtgcgctttgtcctgtgccacatgttgttctaggcacgggcccttcccacacggcgttgacagccaggctagggggaacaatactctcctctttgaagtaactgtgaaccatggcgtgtgcgccttgtagatggaaagtgctggaggaatctagacggggtgacatatgggaggccctgcaagagtcaggaagcatctcctggaagaagtagggactgagtagagtcttggaaagccaggcaggacacctgagggaggagaagacagatgcgggtgttctaagcaaagcagaagagggaagcagaaattgtgtgtttgcttatttgtttgttcactgagcagatgttagtgagtgtcaactttgtgttagcctctgtgccagggctgctggatgtagcagtaagtgaggcctgtttatgggacatgagaagcacatgtagggggtgtaactgggaaattaggttgcactgggggcagggaggtggaatatagagcaaataacaaataccaggacacatttgactctggaggatctgggcctcagggagattggaaagccatgaaggtttttagattggagagtaacccagtgaacataggtttaaggagagaatatcaggtccaccaggatgtgtagataggtgggagaaagaagagggagaagtatggagagagacggataataaataactcaggcctggtggggagggcctggaccagggtgtgagttagagctcaggcagcaagaggtaggggcaaaggagggaagccttcctgggtgacccagcaataaggacaagggctagttgggaggcaggcgggctgatgcgtccacacctatgtggccaggaggaaggcaggagggcgcctagccagggctggaggcctggagcagccaggttgatgagccatcagaggagaactctggtcagttgcactgggccttcatgcacggactgtcctggcctctgcctgcgcctctacaggattcagcactttctcacgtaccccacaaagaacccactctcagcaaaagcattactgagcaatgttgacttctctgaaagctttatgggaggttttacatcccacgcccacagcagacagctcaggaaactcttcttcccaaagtccctgccaactgggagccccctcttctttctatccactcctgactccagctgggattccccacagacaccaccctgctttaacatgccaaacaattaggtcctgcctcagttattacttctaaacttgtccaaaccccttgccttcagaaaacagcggaggtcataagtatcatcaatccaattttctcttgtagtattttttgaagttgcttaaggcagaaccttgtcaccattcacatttcattcatgtgttcattcaacaaatctgcattcagcactgccctggttagactgggtgagggagtgggggaggaggggatatagagatgaacaaaatacagaccctgccttcaagagctggcagcctggtgaggtgaacaaggccacagacatacataaggtcggcaccaggcagagaggtccagaactgtgagagagacagattcagtgctcaggcagtaccaaggcaggaagacagaagcattgccaaccagggtctgagaggcagcattggagctaggcttggaagacctagatgggatagtttggtagttttggggagtggtggcaaccaggcaagatctgcagttcaaagtccaaaatcagaaaagaaaaaatctgaggaagtcaggagagaaggtaactgctggttctcagccctgccctcgagagatgatttgggtaggtcccctcttgaggctgctgccccaacaggacccaagagtgacctcacctccctctccctctgcagactgtgaaaggagggttttctgagacaaggatcgagaagcgaatcatcattactggggatgaagatgtcgatcaagaccaggtatgggggtagcaaccgttcttcccagtgccactgcccagtcctcaatccctcctatgttgggttacccatggatggctatcctcatgggcagagaaggtgtccacttcttgctgaccctgttcagataagaaacccccaagagaggggcattggatgggagccagaaggagccagaagacctgagctctagtctctccctttagttgtttgactttgcccctctctgggcctcagtttttccagctgtgcactagagggcttgctgttcttcacagtctctctcgtcttggatagttcatggttccttcctttgctgttctttaccaccaggccctggctttggccatcaaggaggccaaactgcagcatcctgatatgctggtaaccaaagctgtcgtatacagagaaacagacccatccccagaggagagggacaagaagccacaggtaaggctcctgaggcccagcaaccatgagagagaggagggagcagtagcaagatcctctgagggccatttccatctgagaagccagtggcttgacccctagtgcagctttgaccctccccccatcagccttcctgatttgctgctcaaaggagagaggcacctccccgagatacaagtcggtggggagaagaaggaagactggttccttggtttctttggggtttcaggctccagatccagaaaaataaatccagaagtggttaaaaatttttttaaagggagggaaatggagagaggattgacagtggatattgaggtgggacagatggaggtcctcattatctccttgggcattgtctataaaccggaagtcagaaaaagtcctactaggcccagtgccacgttcctggccctgagtctctctctctatcacaagtcactgaatgttgttaaggggccatgatgaccagagcccttgatcccttttgtcttgcttgattgcaatttttatattttttgagatggagtcttgctctgtcacccaggctggagtgcagtggtacaatcttgactcactgcaacctctggctcctgggtttaagtgattctcttgcctcagcctcccgagcagctgggaccacaggcgcccgccactgcgcccagctaatattttgtatttttagtaaagacgtggtttcaccgtgttagccaggatagtctcgatcccctgacctcgggtgatctgcccgccttggcctcccaaagtgctgggattacaggcgtgagccaccgcacccagcctaatttttatattttcagtagagacggggttttaccttgttggccaggctggtatcaaactcctgtcctcaagtgatctgcctgcctcagcctcccaaagtgctgggattacaggcatgagccaccatgcctggcatgattgcattttgacttctgagacctgcaggagccaaaatcttagggactctaatattctcttgtttcactgtgggccatcaatgctttggtgaataagagaaataagatgatgttggggcagatagggcttttaagcaacctaaattaggggaggggttcttctgggccctctggaaatttaccagatcttatcagatcttaaagcaaaatcccatagacattgagttggataaaataagccaggcacagaaagtataaactgtatgattccattcgtagggagtccaaaagcaagcaaaactaatcgacaaggttgaaaatcagaatattcctgattttctatctgagaaaaaaattcttctgatttttctgttacttctgggatgcagtattcacaaggaagagggaagggccagaaaggaaccttctagggtactggaaatgtcactattttcaactgggtgggttacatgggtatatacatataaacacatttataaaattattctcccacttagagttgtgtacttcacacatttcatgggctctaccacaatgaaaaaaaatccatctcaaagaccccacaaatataattgctggtctcctttttgcccttttccttgaatgaatgaaaccagtcttttctagaaagatacgagaatgtttctcttcctttgattaccagaccccttaatgtcagaagaaaaagcactgaaacattttcctgctgctctgaaaggctgctaacctctggtctggactagggctgttcagcagaactttctgcagtgatggaagtgttctttctgtgctgtctgggatggtagtcactagccgcatgtggctattgaggacttgaaattggctagtctaaaaagaaatgtgctttaagggtgaaatacatgcaggattttgaaaatttaatataaaaaaagtaaataatctcaataatttttacattggttacatatttaaatgataagggatacatcaggttaggtaaaatgtactattaaaattaacttcatctggccaggcacggtggcttatgcctgtaatctcagcactttaggaggccaaagcaagtggatcacctgaggtcaggagtttgagatcagcctgaccaacgtggtgaaaccctgtctctactaaaatacaaaattaggagtgggggttggtgggtgcctgtagtcccagctactagggaggctgaggcaggagatttgccttaacctaggaggcggaggttgcagtgagctgagatggcactattgcacttcagcctgggcaacagagcgagactccgtctcaaaaataaaataaaattaaattaatttcacctgtttctttttaaactttttaatggaaactaaaattgagaaatttaattgtgaaattaaaattttctatttatctagaaatttttagaaaaatagaaatatatagaaaatttaggaagtgttatctagaaaatctattatctaggaaaaaaatttttttttttgagacggagtctcactctgtcacccaggctggagtgcagtggcacgatcttggcttactccagcctccacctcccggattcaagtgattctcgtgcctcagcctcccaagtagctgagactacaggcgtgtgctaccacacccaactaatttttgtatttttagtagagacggggtttcaccatatttgccatgctggcctcaaactcctgacctcaagtgatctgcccgactcggcctcccaaagtgctaggattacaggtgtgagccactgcacctggacctatctaggaaaattttaaattgcatatgtagttcacattctatttctattggacagcactggtctagaagtgtaggttggccatgggcggagcctacctcccaggcttcctcagaccttcatacaagtgattgtcattcctatcccctcagtttttcaatcattcttcctttattcctcccaaatctcagagtggtagagtgtaggccacttgctgagctgggtgtatcacctggggaagcctgtttaaaatacaggcactggagaaccctctccataaagtctgatttagaaagactggactgggacctgggacctgtattgcctgggaatcttcatttctgccttggtccttagggagtccgcgtgcagccaggtatagtagcattgatgcaaagaactctgtattgggaatccagggacctggctctaaagctgttccactgactggtgtgtgaccgtaggtccgtttcttcccgcttgaggactcggtttcctcacttgcaaaatgaagaggtggagcgagcccccttccaattacagtcctctggctatttgctttcctggggtatctgttgtgcttttctcatctcttctccattccctctctcacgcctcctcatctttcccagggcattcagaaccaggcccccaggctcccgccttcccatttccctagccattcagagccctcatcctggcctccacatcctgcccaccccgccgcgatgcagtctttcacatctgcccacctcactgctccctttgctgtctcattccctcctcctcgcctctctttagttctttctttgctgccattgccccacgcaccaccatgccccatctctctctcttctgggttgttctgtaaaggtcaccttgtttatgttgccctggcaagccagaagtttctctcccttgccttttctgcccacatgctttaccagtaattatggtcaagtagaacccaagtctgactcttaatacagtcagactcactaattctagaagaggtctcctctgaattcaaaaactcctttttaaagtgcttggaaacattggcttaatggatggatgcctcttggtaccccaaggaagagctctgtactcctgcagagtctcaagccctgccctttattagctgtgtgaccttttagcaaatcatttaaacttttcagcctatgattcctcgtcagccaaatggcaatgatcatcacagtaataacaatcgctataatttatggaaagcttaccctgtgccaggcaccaggctgtgcactcaacacaagtactgttacctgctcattcattttacaaatgaggaaactgagggtcagagatgttaagtggcttgctcacagtcatgaagctgtgaacatgatggattgattagagagtgaaacccaatctgttagactccaaaacccaatggtcttgaccttttcaccacacccacttttcataacgtctgtctcctagggctaccaagatcatccatgcagcatggtagttagcacactgcctaccacatcgcgagtgcttaataaaagctcattatgactactattaccattaacttgaaataggctaacaaaatgctgcacgcagggactgtgctgtgctgtaataaaccaagaagaataaatcataacactgtattgtttagatgtctttggtacttctgaagtgtctatgggcttacgaagacatcccacatacccagaataatgattacactgacttataggacagccacttcattaattgatgcacaaacttaaagtgcagcctgttactgtaaggaaaaaccaaaccaaaccaaaccaaaaccaatgcccagttaggatgtagtaattttgctactgagtaatattctttgagtagtattctttctactcaattttgaccaggggccaggcacagtggctcacacttgtaatcccagcactttgggaggctgaagcaggaggattacttgagcccaggggttcaagaccagcctggccatcataatgagaccttcgtttctataaaaaatgtaaaagattaactgggtgtggtggctggcacctgtagtcccagctacttgggaagttgaagcgggaggattgcttgagtccaggaggtccaggctgcaatgagctatgatcgcgccactgcactccagcctggcaatagagcaagaccctgtaaaaaacaaaaaacaaaaaacgaaacgaaggaaggaaggaatagatggatacaactaggttttggagctagaaacaccttggtagctgtgtgcccagaggaacctctctgacctcagtttcctcatctgcaaaatgtcattaatgtatacattggagttgctgtaataactaaacaacacctgtgatatactggatctgtgtcttgcctacagaaggggctcagcaaggtgaacctgcttccttgtccctctgaggtttttccatgtttagaggttgatgagagtactgagaaagtcagatcgtaattctccaccaccagcctggtgcctgaggccctgtctccatgagggtgtttgtcttactggtcttcatcttctgttccttctgcaaatcctccagaaacatctgtccctgcttcagttaactctgtcttccttcttaaagttcttccttcttgaagttcttgctatgagcgtggaaagtcactcatgtcacacagaaccttttcccttctctccctgcaaccttgcaggtcagacgtctggtttctgctccatcttctcccactggcccacctccttcagagaggacctgtctcccaaacaccaccagcaagagggcagcacttgcctagcttcctaaccttccaaaatttaatgggaaaaaattgacctgttccaaaacaggaaccttgggttttagtcttggttttgccaacttactaagcctgaagcctctgggcctcggttttcctatgtgtcaaatgagccaagaaagatccattttctgtgattccgttagcactcgactgcatgcaagtagcagaaatgatgtttcatccattaaatggttttgagtagttgctatgtgccaggcacagtgttgaacactggaaagacaagagttaaaagatagcccttaccctcaaggagatcagagtagtgtgtggttaaattaacaacagcaacaatcatcataataagaacagccagtatttattcagcacttactatatgctgggcccttgcttcagttcctccctataatgggaggcagaacctattttacggaggaagcaattgaggcttaaagaagttaagaaacttgccaggcactgtggcgtgcacctgtaatcccagctacttgggaggctgaggcagaaggatcacttgcagccaggaattcaaggctgtaatgtgcattgattgtgcctgtgaatagctattgcactccagcctgagcaacatagtaagactcgtctgttaaaaactgtttaaagtaaaggaagttaagaaactcacccaagattacagagctagcaggcccatagagtgggatttgaactcagggagtctgatttcagagcctgctcctttaaacactgagttttggagccaaacctggaatccagacttcatttctttatttaaacactgctgtctgtggtttaatctccaggacacagcaagcccacggacaacagaaaggaaaaccaaatgaaaaaagaacatctgcaatcgtgactaaacatttcttagagctgacaagataggaagaaaaagtaaaatgatgatgatcttagcttctcggtgttaaaggacattttaacacattgtcaggccaaagtaaaagattaccacctccctggaaacaagcgagcaaacacacatgggctctggaatccaacagatgtgggttcggttctctgctgccacacacaagctgcgtggccttggagtgcaatagctactcacaggcatgatgattacacattacagccttgagtttctcacctcaagagatccttccacctcagcctcccaagtagctgggattacaggtgcaagtcactctaccttgctgagtcacaataaagggcatatggtaaagggtagcaaaaacaacctcttgccatgtattttaaaacaagtgacagaagttactaatttttcttgtcctcttccttcctttccccccactccccaccccccattctaccccatgcctctggcttccaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccatacttccttggcacctctcctctctctctctctctctctctctctctctctctctctcactgtctctctctgactttggccactggtacaagttggcactgtgggaggggctaaaactgaagtggagacatcccaacttagaacatgtttatgcaacaaatatttggaactcaaggtggtccaggccttgggtgactctccaggcacaacacaaacaagacaaaagtccctgcccttcatgaacccacaggctagtggaggaaacagatgccaacacaggcaaacagtccgttacagagcactcagcactaggaaggaaatacaccgggagaagggaaggagggtcactgaaggagaccactttaaatacagtggccaggtaaggcctccctgaggaggcgatctgtgagctgaatgaaaagaaggatcaatcaacaaaggcgaggaactttggtgcacattctaggagagggaacagtaagcatacaggccccaggacgtggaggggcttattgagcggagaaacagcatggtccctcctcctgaaagaagagtacctacattggagtctctcttcctgtaacccccctacatgggagcctagtgggaaaaaatacagcaatcctcaacttcggcctttgcccagaacctctatatatgttcccatatcctcataccacctgtcccattattcacttatttttctttaaattgactcaggtcaagtgcagtggctcacgcctgtaatcccagcactttgagaggctgaggcaggcagattacctgaggtcaggagttcaagaccagcctggcccacatagtgaaatcccatctctactaaaaatacaaaaaattagccgggtgtggtggtgcacacctgtaatcccagctactcgggaggctgaggcgggagaatcgcttgaacccaggaggcggaggttgcagtgagccgagatcgtgctactgcactccagcctgggtgacagagagagactccgtctcaaaaaaataataaaataaaataactaactaaataaattgactcacgttaaaagcaaatgcatttaaaaaggaaactatattacttccacaaatgaaaagcttatgttatttgccaagaaaggaggtcttcataaaataaatgcaaaaatattaaaattaacaaccacaatgcacttaaaacctaaactcatcccttggaccacctgaggtgcacacaccacactttccttttattccaccaagcaactcacctcagcccacctttattgctgcaaatctcaccagcgagtcttttccatgtgtatgtatttttccagagttggtcatcttgtacatacttttgtaaatactttaaaatatatatatgtacatatatgtatatatatgtacatatatatctatatacacgtatatatatcctgagcatttccgtatactttcaaatactaaatacttattttctttggaaaggtaattcattaaatgatacaaagactatgcagtgaaaagtgattcttcagccttctccagatttctgtctcttgtcagaggcaattgctgcgaggaacattatgaatccttctctgaattttccctataggtctcctttagcaatctgttatccctagggttctggaataggacttggtttacaaacaatgggtcttcatatgattcctcaggaccccatacaccctgatccatatttctgtctcccataaaggaccatcctgactcggcttttgtcgaataatcaaaggtaagttcacccagattagtgtttttcaactgcattgagagtggggaaatgacccctcctcctttacccccaacccccgccccggggacatttagcaatggttgtcacaactgaggggtgctactagctctagtgggtagacgccagggttgctgctaaacatcctacaatgcacaggacagccacatacaacaaatacttatctggccccaaatgtcaatagtgccaaggttgagaaattctgatctaaatggacatgtgacccacaaggtgggactcctaggccaccatttacagcttctacaaccagtgttcagtgtcctggagtctctgaaaagacggtgagcccaactgaaacagggagctttgagaccagaccatagagctcagcacttaagactgggagtggggaggggtggagagggagctgagcttcttcatgcaggagatgaaacttgacaggacaggctgagattggtaagcatgactgtgactgatggaggctgtctctggttaatcctgcagcagctcattgtgattaaccatgactgcagggcccggtctagtctgcaacccactaagagataaattttgaccgagacagattggcgtgtccagctgtcactgaggaaatgtgacagacaagctaaggagcagcagcacaagagataagaacagacagcccttggtttgcattctagctctgccattctctggctgtgtaacatctctttgaacctcagttttctcttctgcaaattgggaatacacataccttacaagggttagtgcaaggattataaatacccaagtgggccgggcacggtggctcatgcctgtaatcccagcactttgagaggccaaggtgggcagatcacctgaggtcaggagttcgaaaccagcctggccaacaagatgaaaccccgtctctactaaaaatacaaaaattagccaggcacggtggtgggcgcctgtaatcccagctacttgggaggctgaggcaggagaatggcttgaacccaggaggtggaggttgcagtgagccgagatagcgccattgcactccagcctgggtgacagagtgagattgcgtctcaaaaaaagaaatacccaagtggcctgccctaaaatcacataagccaattcttggcaataaatcacttaatatagatctcctactggctctgtatctttggtggaaccctgattaatagtgcagggttagacccacaaatagttatttattaataccaaattatcatcattattaattaaatgcataatatatgtactcagctgagcttttgtgcctggctttgtgctcggttccagggaaacagtgaggaacaagacaggcagattccttccctagtgcgttgatagcctgactgagatgttaggacttggcctgcaggaaggacacggggtgataatggccagagggactgaggtggcgaccgctgctgctgcagcagcggaggctgacgctggttctctctgggctggtggctgggtttctgaggctctccccgagggctgagtgtgactggaagctgagacactgtgaccgggatagagactggctgacaaagacagtgaccgagcgcctgactggctacttctgaatagtagccactggtacaagccttggctgtgctttagtgaccatgactgcttgagcccaaagtaagatggctggtggctgtgtttctggacggggatataaaatgcataggttaatgaaagttgttcacaattcagaagctaaaacgagaaactaagaataacaaaaggcaaccttgcatccggcggaacctgcaggcacgggccattcttcccgcgacccagggctctgccggaccgcttcccccgtcgctccagtcagacgccaaagctggagaacttccggtgcgtttccgctgtaccggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccagtaaggtctttccccgaactgaggctttgtttctcgtttacaaaatggatatcatacttgtattaaataaatgtttactaagcgttgaatctgtgctagggatacagcaggactcaagtctcgtggcgatgacagccttcaatcaaacatccaaaactgcagttgtgatcattgagacggaaaggtacaaggcaccccagattatatcacaggagacctgacctagccccagggcaaggaacctttactgaggaggtgaatattgagctgagatcagaaaaaaggatttgacaaagtggggagggaagagttttctatatggagacagcctccaatttcaggttctgaaagaggccgttgtggctggaacagagagcttgtgggggaccattgtgtgacacaagctaaaggggttgccaggagtcagaccgtgcaggctttgtaggtaataggaagaattctggtttttcaagaaccatatgggaaaccactcagaagctgacatgggtggtgttgtgattagattggcattttgaaaaggttactgctgttgaatggagaatgggttgaggagcaagcactctgagtgagggacgatggtagcttggattagggaggtggtggagagaagtggatggatgtgactttaggtgttccaggactgtgaggaactcacagagctgtcagtgacaggggctggtagactgcagagttctatgcatatttaataaacgttttcctagcatctcctctgtgctaggccctgtgccagctgctggagatatagtgaatagaattacagactggtggaattagcatgaaagaaacgtcattatcaaggaggagcacacagatgtcacaagggaaaatggctaattgatgagctgttattgtaaatggaatatctgttcattcagcaaatattaaatactttctgaattcaggattacaaataggaagatgatacgtattattattattattattattattattattattattattattattattttgagacggaattcgctcagacccccaggctggagtgcagtggtgtgatctcagctcactgcaacctctgcctcccaggttcaagcaattcttctgcctcagcttctcaagtagctgggactactggcgcacaccaccatgcgcggctaattttttttgtatttttagtagagatggggtttcacagtattggccaggctggtctcaaactcctgacctcattatccatccgcctcggcctcccaaagtgctgtgattacaggcgtgagccaccacgcccggcctgttgatacgaattatttagagcagagtctttcaaacttttatgactgtgacctacagtaacgaatacattttatggcacaaccaagtatacacacaaacacacaaagctccagaaaacagtacttagctttactactcatgatgtattgtgatatttcaaaaattctgttattttcgtttaaaaaataatgctggttgagaccttcacattgatttcctaatccactaatggattgtgacttgcagtttggtgaaacacaaagtgctgattcagggtaagagtcatttgtggtggttttgaggtaacaatgataaaatgtgctcttatttttggaaaaggattggtcttcctttctgcactgctttatttaaagtaaaaagggtaaacagggccaggcatggtggctcacacctgttatctcagcactttgggaggccgaggcgggcagatcactgaggtcaggagttccagactagcctaggccacatggtgagaccctctctgtactaaaaatacaaaacttagccaggtgtggtggcacacaccggtagtctcagctgcttgggaggctgaggcacaagaattgcttgaacccgggaggtggacgatgtagtgagccgagatcacgccactgcactccagctggggtgacagagcgagaccctgtctcaaaaaaaaaaaaaaaaaaagtaaacaattaaacaggcagctcgtttttctgtgtgtgaaattttgacgtcttggctagattggaattgcctagagggcagtgactgtcttaatctgtgatgttttttgggggcctggcaaagatcctggcacaatgcaggcactcagtgagtatttgttaaattagtcaggtaggtatcttaggactagaaggttgcataatggtttgtttacatttgttcatgttggtaccattcttgccgatatcccagaggcaatgtctgggatattcagaagtaggtaaaataagtgtactaagctctttctcttctggccagctttctcttcctaggctagctttaccacctgaattcattctggatgaatggtccagagccaccactgattgtgggctctttgggaagttgtttcactccctggagtttaggttttttatgagtgaaagaagaggggagatttgtggtaggaaagctctctagaccctgaacaaactttagatgctgagcctccacttgctaccgtctgtccatttctgggccttccctgaggcttatgggaaactggatatgtacttgatttaatctttccaaatcttttgggatagttttttggcagaattgtagttttaaatgatgtaggcatatagtttagagtgacctgtccaggcattttccaccctcaccctctgttgtgagaaagagatctgagaagatattaagaatggacggtggacagaacactggcctgcaggcagggtatccagattctaatttgggtcctggtatgaccatgagcatgtcacttttctttcactggtatcttatagctgtgaagtgagtgtccttgcatgttaagccaaaacacaaaaatcctttcctttaatcctcgtttttctcatctgtaaactcaatgcagggttgtcatgaggattaagggaaataattatgtcaggggtctaactcaatatctggcacatacagaatgcttagcaaatgaagcatctttcccccacgttctgattaactctggtttctttctttctcagctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgagaaggaacaaggctctttgggagtgggccaaggggaggatattagcagaggtgttttggaatagggagtacatcttgtgttagtccagcagcaactaaacctggctaggaggctgaagatacaggtgtgtctttacccttagccctggagatttcgatttgagagatctggagtggggcttccgcagtttctatctgtctaataaacaaacatcctaggtgaacctggtgcagataatcttctgtttgggaaccactgatagagcccagtcctacagaaggaaaagatttggcccactgagtggctgaactgagacgagaacccaggactcttggtttctgggccagacctgtgttcgttgtagcctctcacctgcctgctcagtttgctcctgaccctcaagatgttggtctctcaactggcttagaacaggacagtgattttttttttaatcattacagtttttattgttaccttcccttttattacaaaaatgatagataataatcataaaagaaaaacaaaatttacttcaaatctcactacttagaaataaccatttaaacagtttggtatatttacgttcctttttttctgtgtatttctatgtatttcatttcaatgtcttctctgtttatttctatgtacttcctctcagtcttaaaaattcagtatatgtgtctgtatatatatgagtttttataaaaacaggattgaagtatattattactttgtaatctgccttaatataaatgttttttcatgtcactaacagtcacttttttagtggctgtttcatgttccatagttattggaccagttctctgttatggaccattgagatgctccctgttttctctattgtatcatcaagtggccgggtgtggtgactcacacctgtaatcccagcactttgggaggctgaggccggtggggatcacctgaggttaggagttcgagaccagcctggccaacatggtgaaaccccatctgtactaaaaatacaaaattagctgggtggtgtgcacctgtagtcccagctactctggaggctgaggcaggagaatcacttgaacccaggaggcagaggtcgcagtgaaccaagacctcgccattgcactccagcctgggcaacaagagccgtctcaaaaatatatatacatatatcatctagtgaacattctcgtgtgtacttacacatacatttagggatagaattgctgggtcagactgtgcatgttgccaggagaaggtttttgcatccttgctggctggtaggaacctgttgcccatcacctttgacagcattgggcatgacagtttaacaaaggcctcttccaattggatagctgaaaaatggcaccttgtttatatttctttatttcttaaatactagtgacagcaaatatgtgtcacattttgaacagctatttttatatatatttataaattttccaggtaatttgcatattttcttgttggaagttcagtgagaaatttgaatgtaggacttcttttttttttttttttttttttgagacagggtttcgctgtgtcgcccagggtggagtacagtcagtcacacaatcatgtcttactgccacctcaacctctcgggcccaagtgatccttctgcctcggcttcccaaagtgctgggattactgtgcctagacaggactttttatatcattggctcagctaatgatataacctatattttaacaggtacatcttttgttgttgttgttgttgttgttgttgttgttgttgttgttgttgagacggagtcttgctctgtcgcccaggctggagtgcagtggtgtgagttcggctcactgcaagctccgcctcccgggttcacgccattctcctgcctcagcctcctgagtagctgggactacaggcgcccgccaccacgcccggctaattttgttttgtatttttagtagagacagggtttcaccatgttggccaggatggtctcgatctcctgacctcatgatccacctgcctcagcctcccaaagtgctggaattacaggcgtgagccaccgcacccagcctttaacaggtacatcttaatgcattagtattttcgtataataagtaacttttaaaagtctggcttaaaaatgaatagaaatcctgtctttctacctcttaaacatttcaattcttcaaaatatatcttgcgaaaaggtctgttacaggaataactttgttggtttttttttttttttttttttgagacaaggtctcactctgtgacatgggctggagtacagtggcatgatcacaactcactgcagcctcaacctcctgggctcaactgagcctcccacctcagcctcccaagtaggtgggacttcaggtgtgtgccaccacgcccagctaattatttttggttgagatagggtctccctgtgttgcccaagcttgtctcaaactcctgaactcaagcaatcctcctccactgacctctcaaagggctaggactatccctgccaccgcacctgtccagggataattttgaatctacatcacacctctttgaaaaatataatttaattttagataaagtcagaaatgcacaaatttaataaatgtcctaaacgcaaataataggctaatatttagtttcacaaaccaagtaaagccagctgaagaagcaaatcattaacctatattatacaaagaaaatttgactatatttgaaaatattggtcagaaatccaaaatttctaaaccaggtagctattcacacaaatcaaacttagttccgtatgcttaggaacagggagctagtttttccaggtctctggaggtggcacagatcaaacgccatgcatttaaagaggtatttggtgttgagtacatctcttctttttatggcccacatgtatgtatacctcattaaatttccagccacctttgaagtagagagaatgcctgtgatgaggagcagtattctgtggtaaccagagacccagttacttgcccagggacagtggtgtctggatcatcaggtctctgtttgagatgggcatctgatagaaattgggaacataatattttttgagtgctactttgtgccaggtcttattctaaatgctatacatgtactatatccattcatgtaatctttgctacaaccctcaaataaggaaattgaggccttaatagattgagtaacttgcccaaggtcacacagctgctaagtggcagagctaagatttgaagctaggcagtttggctccagagcccatgctcttagccaccaagctgctcatagagattaaatcacagagccctgtggttaagcaaacaaaaataatctgcctggcaggctgaccctggaataagtactcatgaatttttcttttgtgggaggttccagaactgttcccacccaatggagaatctgttttatctttccgttgcccacattgtgaagcattagatgtgtggccttgggcaagcccttgaccttatctatgaaatgaggcaaataccatcttcctgatcgccttgtggagttgggctgagggttacatggtatagtgcagtatttcctgaccctggagcagaccatccacattagaatcacctggggagcttgttagagctacagatacgaaggccccatcatctctcctccaccagaacctctgagggtgaagcttgggtagctttacttttaacagactctcagtgattctgatgggcagccaggtttgaaatccacttggcataatatccatgaacacattttgtaaacttaaaatgccaggcaaatactgggaatacctcttctctagcagtctgattttatagaaatccaaagccacaggttggtttcccatggcttgaattcatagcggttcagcagacatctattgagtacctgttaggtgcaaaatctcctgccaggctctgcaggagtgacaaggataaaagctcatctgttgctgaggtccagtggaattcatggccttgtgaatagtgatggagagtgtcagctggtcctcctctccctcagaatcacttctcctctctgcacctttcaggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggtgagcagtctttctgactgagctgatgcacatgtgggtcagaattgaggcaacagtatgtgttttgtttctcgctattcttccatgaccccaaaatttttaaatttcagtttcctagtcttgggatatttcctgcttttctctctcttactcaattgtaagtgcctctatgccagaaattttctctctgtaccaccctctccctacacctcgtccccagagtgcctaacactggggtacttggatttgaattcctcccactgctttggtttactcagcttaaaacagcgtttctttctccctgtagccatgaattgctacaacccagtaaagcagaattttgaagtttgttattcccagtgaaacatctgcagctccttagatctcatttaagcattaaaataactttgatttcctgttcaaacaaaatgtgccagtttctgcagagattctatgacagaaaaagtgaaatttgcttttaacttggcaattaaattttcattatgagtggtaattaggaaagaagcttcaaacaacttacaatcttcatcctatgctatttcctccctttgcaaacagattagtcctttatgtacttgggacagcctctgtcactcacattgtgtaactttctcaagaatagaagaggcagaagctgccactgtcagtttccatactttccctcccatgagcttctttcttctccctgtgtgtaatacccccatgaggcctgctccatataaggcagcctttcaccaaccttccaatcccactcggggtaacagaagggacgagcattcgttaaatattggggctgggcgtggtggttcatgactgtaatcccaacactttgggaggtgaaggcaggaggatcacttgagcccaggaattaaagaccagcttgggcaatatagtgagaccccgtctctccaaaaattaaaaaattggccaggtatggtcatgtgcacctgtagtcctagccacttgggaggctgagacaggaggatcacttagcccaggagtttgaggctatagtgagcaatgattatgatcgtgccactgcactccagcctgggcaacagagtgagaccctgttcactcattgaatccctttggagccttgtaagatgggggtattattcccattttacaaatgggaacacttgagaatggttaaatcacttacttgaagtcatacagctggcaggtggaggtcaggatttgtacccaggcctgagtcttggtttcctgcctgtgcttatgcccttgtgtagtgaacacagtgtgaatcccccagaaaggattcttgattgacatcagtgaagacttcatcgaggtcctgtttctcagaggtacagaacgcttttctaaagccaacctactgttggatgagtccctgtgagcaggcatctgacttaaagctggcagttgaaggacctgtgtaaaccatggcaatgagtcagtcaagcgcatgatttgagcctggtctgttccactcagaagagctataaaactgtccttttactggttcttcatataacagagaaattaaacccctttgtccttcctctgtggggaaaattttccccaaaggtactggttatgggttgtgaggcagtgtgaggaggcattagcctgctaacttgcctctggcagtggctgcttccctcctgatgcacgttgatgcgtcgcacagacacaggagggccacggtgttgctggctgtccagaccattgttagcacaaccagcagctgagctctataattgccaggctttgttgccagcaatgatttacaaagcagaaagtgcccagctggattgctagatgcccaggtgggttgtgcaaagctgatggttggaaacattcagtctttgaacttttcaccaagaaaattcgatgtcattatttggaaaaatccagggcatgtgccaaaacaaaacaaaacaaaacaaaaaacacatgtctttgagcattcttcatatataacattctactgaaagtgttgaggaatatatatacatgtgagttagccagggttcctgccctcaagggatttgttcattgatttagcaggtaattgctgagcatctgctgtatagaagactctgttctagaactgggaatatagctgtgagcaagacagagtcattgtcttgactcttgtaatttgagaaagttaacagaaagttaactagccaagtaactccagatagcagactcttgtattttgagaaagttaacagaaagttaactaaccaaatagcagtaagcaggtagcagtaagtgttttagaaggcagtcctgccctagtaccatttccctagccccggccttttggtctcacctagactgcatcggagtttaccagcctccgtgcttaccagttaccccatctctctcccacactgccacctgaggtgctgctccataatgcagctgtgatcctgcttctctgtggctcctcattgcgtggaaaattaaaagcctaaacattggtcgcaaaggccattctgatctggcttcttatcctgttctccagcttctctttcctctccgttttcccccatcaactccagcaacagtggtctctttgcaggttcctggacaggttatgctgtttcatgctttttaaaaaaaaaaattgttgtaaaaaacagctggtccatggtggctcacgcctgtgatctcagcactttgggaggccgaggctggaggatcacttgaggtcaggagttagagaccagcctggccaacatggtgaaacccccatgtctactaaaaatacaaaaattagccaggcatggtggtgggcgcctctagtcccagctactcaggaggctgaggcaggagaatctcttgaactggggaagcagaggttgcagtgattcgagattgcaccactacactccagcctgggcaaaaacagtgagactttgtctcaaaaaaaaataataaaaataaaattgtggtaaaaaaaaacacaatttaacatatatgccctcttaacagattttcagtgttcagtacagtattaaccataagcatcatgccatccagcagatctctagaacttcttcatcctgcataattgaaactttatacccatgtttcataccttcttgccggaacctgattttccctctccctggtacatatttgctcattctacaacatgccctcaaggcatccctctctgtcaagccatccctcctctctctgtctcaatctctgtctctctttcactctcccctttccctactcttagcttactttgaacttgtcgctattatattgcatgagatgtgcttgctgaaactaatatattgtctgcctgactcccgcactgagtcatgggctccttttacacgaggcctattttttgttcatctggttatcttcttcttcttcttttttttttttttttgagacatagtcttggtctgtaacccaggctggagtacaatggcgcgatctcggctcactgcaacctctgcctcccgggttcaagtgattctctggcctcagcctcccaagtagctgggattacaggtgtgcaccaccacgccaacctaatttttttgtatttttagtagagatgaggtttcgccatgttggccaggctggtctcgaactcctgacttcaggtgatccacccaactcacatctggttatcatcaatatgttgtcaaggcctaacatttatgtcatttggtgttattgggtgtttttagatggatagagttcataattcttgtgacaatgtaaatatcataggtataaacagtggagtctgatcaaagggcgttaggagcaccaaagagggagtggttaattctgactggggttgagatttgaggctttatgcaagggtggaaggtgggggcatttgaccatgcacttgagggatgactgagatttcaaaaggcacaatgtggagaaggatattgtaaaactttttttttttttttaatggagagtcacgttgatgccatgttggcagtgagagtccagttctccacacagaggcattcactcagggcatttgtgactgaatgaatcagcccataaaagccttcctcagccagccgcctgccctcccaggtagtcaagtaagtggaactggctgtcttacttaggagcttaaatggctactacccatggagagggactggtgtttgtgtgtgtgagcacttaaagacagccacattagcatggataaaatcagccgcgtaatggaattctcttagccattaattttttttcaactttcccatgtgaggcccttttgaatagaagccactggtttttacaaatcccttggatttcacttgaataaaagggatttgttttacaaaaatagatgcagttttttcttttatttaaagcaacgtaagtcaccataattcatttaaaaccaatgaaaggataatctgaatttaatgatatgttagaaagtgagttatgtacaaaataaggatttttattgttgattacgtagtacttaggcatatagtcatctaacctgtttttaaaaatacttctagttacaataggccgtatatgctttccaacttcctttgttgctagtattctaaatgtgtgttcatctttaactcttgagggaaaacaccaactctgacgatgaggtctatggtatttttatcacgatgcccactatgataaatttgcctgcctactcctacacctcttgccattagctatctcttttgcatgcttagtctcattgagccctcacaacagtgctagaagctaggtctctaatcccattatatagatgaggaagcaggctcaggaaggtcacataatttgctcaaaatcaacagagctagtgaaaggcaaggctgagctttacattctaaagcctatggtgggctcctgtatatgattagagccccagatgaaacatcccagatttttcaaactgacctcaggtgatctcatttatgctgctttttaccttcctggtcatcattgtgaaacaatagtcttgcttttaacaccactttcttctgctgcaagtggaaacaaaatcttctacctattgctagtttcattctaagttgaataattatttgggaattgaaaaaattaggaaatgtcatctttttggtctagctaaaaaaataggataagatagtgacatagctacctaccttgatattttgaatttctcgaggtgacctaactgaactcaatttatttaacttaggtttaagaaaagctttcacatgtgtgactaaagtaatttagaatttcataatacacagattaaatgattaaagtgttcatgctttattttgtgtttgaagaaaaacacccagtaggtgtgctttttgttttagataaatgcatttgtttgcaaaatattatcctatttcaaaagtattttttaaatattcagtattgatatgctgagattaaggtgatttatgtcccagtgacgttaaaaagtgttgacttgattttgttttagtgaataaaataactagaccactgttaagtttcctgaagaaggcgtaaaattaatctgaaaataaaagaatcagaataagttattgcttggaaactaagtactatttagacatcttcatttctgaattgtgaggagtttttacaaataccaagtttgtgaaactgtggtcaaaaatagaccaggaaatgccagggggtaggggtgaaggaagggtttgactgctaaggggccgcacaagggagctgtttggtgtgatgggatggctccatgtcctgattggggtgacggttacacaaatttatacgcaccttcaaactcagaactggataccaaaagcaaagcaaacactgtgaacatgtatcatatggtggttgcatgggggtatatatatatttgtccagattaactaagcatttaaaattgatgaatttactaatctgggcaacatagtgagaacctgactctacaaaaaattaagaagaaaaaaaaaataccaggcgtggtggctcatgcctctaatcccagcactttgggaagacaaggtgcgtggatcacttgagcccaggtgttccagaccagcctgggcaacatggcgaaaccctgtctctacaaaaaatacaaaatttagctaggcatggtggcatgtacctatagtctcaactactgaggaggcctagatgtgtggatcacttgagcacagaggttaaggctgcagtaagctgtgatcacatcactgtgctccagcctaggtgacagagtgagaccctatctcaaaaaaaaaaaaaaattatctaggtattcgtggcatgtacctgtagtcctagctacttgggatgccgaggcaagagaatcccttgagcccaggagttcaaggctgcagtgagatatgatcatgccactgcacttcagcatgggcaacagtgagatcccgtctctaaaaaataaataaaataaaatgaataaaattaattgtgtgtaagttataccacaataaggttgatttttttttttaagtcaacccagactatgccctgtgtcctggaggctgcagaagggacagtttcagaagcaccttggttccctacaaggcagtgctaaaaataaatatcagggatggattaagcctctgtcaagacaaaaggtctgggcaggcaaaggatgaagccgagatgcctctgctttgacaggactctgctcagcatttgtcactgcgtgttgccgcatgcctagtgtcttacctctgcagtgggaatagtaagttcctgtcctgcctcccaggctgtggtaaagatcaagttggtgagttctttaaaaaggacgaagcactttttaaattagaaaacgtatttgttagactgaaggtgtctgttttacctgcctctagtggaatttattcccaggcaatgtttgagaggtgctttgggaggatgggtgatgagcgtgagcccagtttgttccagcctgtcactcctggccattgccaagtgcagggcagtccctgggtctcaataggtcattcggtgagcaccctttgggccctaactctatacctggccctgggtgatatgctttgtggcacacattgataattgggacacaatccccacttttagagggtgcaaatcactgtgatacaagcacagtgtgaggaatgccatgagggaggctcgggcacagtgctggggaacaggggtctgagcagttcatgtcacaaggaggtttcttgagagccatggcattcaggggcctggtaaagaagctgccttctccttaggatgagcctttctttctccccagcatcaccatatcactattgaacagctatttggtgctaggcactgtacaaaagtgaaccccaaattgagtctgtggttgtcttcattcttctgttcattaaacatctaatgggtcctttttgtgtgtcgggcgctgtgccgagagtggagcacggtgtgaaagagccgctgctgtgaggttgctccgtgtctggtggacaagatcaacagcaaatggcctgttagcttactgagactgatcaaggtagccctggggctgagggaacgcagaggagcacctactccatccttggtctggaagagatcctcaaggaggtgatgtttgagctgagcctgagtctttaggagaaattcataggtgaaggaggagaaagcaggagatggaaaggtgttaagagcagagggaaaagcgtgtgtgcagagaggcgcagaggaagcagtggcacatgtttgggcagctgctcagtggctggagagcagggactgtggagagtcatccaattcccatgtaaggaagggaaacaggaagagacttgttaattcagcccagcagtctccccacaacctctggggatggcctcatgggtgtgcagggcctccagagctaaaactgtttgagagaaggcttctgtgctgtccataccaggcccctccccagaattcagccttgctccaggcgggctccactggctgcctacagacaggccaacccttggcttccccatggccctcgccaccaagatcacacagccctgctaattagttattgatctggtattttgttgtggctgcgcttcccactcctgtgtttagtcgattcccaagttaatgaagctggattctgtaccgccccccttcccccccatcacctctctgtgttcccactgctgctactccaacggaatggctccagacaaagaccactgaaaacgagccgcactcctgctaacaggaagacagcggagaagcaggtgggaggaatattccccctggaatcagctgcagaggacgcctgttgcctttgttgggtcaggtctcctgcggcccagcattttccatggtggcctgaaagccaactgtggcatgagggcgatgtggatcaaagagcttcttccaccgtcacaaccctgtgtctctgggtgggcctgtagggtagcagatggtagtctgggaaaaaccacttcttcctttctgggtaatttttattcagtcatttaactcctctcagcttccatttccttaaaataggcattctgttgtatctttccagggtattgggaggatccagttggatgctctgtgaaacttctttgaaaacagtaaaatagtataagaaggaatcatgggtttgctattactcttagggagggactgggatccaggacaatctggaatggggtttcagatgtggaaaaaattaccattctgctcccctgcccatgtttgtattaaatgaaactgttcatgagagcatcagaataaggggttgatatccagaatatataaagaactcctacaactcaacaatgcaaaaacaacccaatttacaaatgggcaaggaagttgaatggacatttcaccaaagaagatatacaaatggccaatgtgcacatgaaaacatactcaatatccactgatcattagggaaatgcaaatccaaactgcagtaagatactacctcctacctattagaatggcatgatttaaacacacagagaaaataacaggcgttggccaggatgtggagaaatgagaacctttgtgcattgctggtgggaatataaaatggtacggcccctgtgaaaaactgtggcagttcatcagaatttaaacagggagttcccgtatgatccaacagctccactcctgggtttctgtgcaaaagaactgaaagcagagaccctaagagatatgtgtacacccatgttcatagcagcattattcacgatagccagaaggtaaaaacaacacaaataggcattgacagatgactagacaaacaaaatgtggtatctgcatacaacagaatattattcagccttcaaaagaaaggaaattctgacacatgctgcatcattaatgaaccttgaaggatattatgctaagtgaaataagccagttgcaaaaggacaaatgctgtatgattccacttagatgaggtgcctagagtagtcagattcatagagacagaaagtagaatgtgggttgccagggcctggtgggaggagggaagggggatagggtagtcgaattcacagagttggaaagtagaatgtgggttgccagggcctggagggaagagggaagggggagttgctgtttaatggctgcagagttttggccggggatgatggggtcattctgaagatggatggtggtgatggttgtacaacagtgtcagtgtacttaatgctactcaactgtacacttaaaatggctaaaataatatgtatattttgccacagtttaaaaaataaaaatatttttaaatggttgaaatggtagatcttatgtacagatgctcctcagcttcacatggggttatgtcttaataaactgtaaatcagatataccgtaagtaaaaaatgcattgattacacctaacgtccctaacattgtagctcagcctcacccacctcaaacgtgctcagaacactaacactagcctacagttgtgcaaaatcatttaacacaaagcctattttataaggaagtgttgaatatctcatgtaatttcttgaatactgtactgaaagaaacaattcaaagtgcagcttcttctgaatgtgtatcactttgcatcatcataaagtcgaagtgtcataaattgaatgtaagtcagggtccatctgtatattttaccacaattaaaaaaaaaatcaaagacagcttttaagggggatagaagcctcaaactggcagcctgtggcccatttagaagattagagcagcaattcagtcgtgttggcttggggcctgggactttatgggatccaggggcttataagcacccccaagcctttcttaggaccttagtaccgactggtgtagctactacctgttcctctgggttactgcccgggtgtccagtagaaccccccagggggtggagccagggtaatggcccccagcctctgcccagatagtaattttccattctagtcctgccctagcatctcagctgggtttggaccttctttcttggtttggggggagcatagcaggtgtcctgggcctatgccagcagcagctgatctacccgccccagaagagccgaacaccatgaggaaatttccacagctttctcgccccctgccctccgtcttctcaggagtgacttatcctctgttctctgtaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaatccccttgtgtgtgtgtgtctcttgcagttaatccgcctgatctccagagcagccaggctactgtccatagacacacacctccctccagtgtatgggagacttgcccaacctctggagtctggaagaggcaggcagccagtgttcctcctgttcctcttgaggcccctgagacaggcacacaaggaagaagggatgaggccccatgtctcaataataacccaagaatcacctgatatgaattggctcctctttttctcccaaagcccactcatcagaactagctggggagcttgtgaaaactgtatctttaaaggagtgaagtcctgatacatgctacaacacggatgaaccttgagaatgtgctaagtcaaagacacaaggaccacctattatgtgattccattcacgtggcatgtccactagaaacaaatccacaaagagggagagtcaattagcggttaccagagaataagacagtatggaatggcagtgactgctgatgagtctgggatttctttttggggtgatgaaaatattctggaattagatggtggtgatagttgtacaaccttaagaatttactaaaaaccactgaaagtaagcacttgaaaatgattaattttggccgggcgcggtggctcatgcctgtaatcccagcactttgggaggccgaggtgggtggatcatgaagtccggagatcaagaccatcctggctaacatggtgaaaccccgtctctactaaaaatacaaaaaaaattagccgggcatggtggcgggcccctgtagtcccagctacaggctgtggcaggagaatggcgtgaacctgggaggcggagcttgcagtgagccgagatcgcaccactgcactccagcccgggcgactgagcaagattctgtctcaaaaaaaagaaaaaaaaagatttttatggtatgtaaattacatctcaataatttctgaaaatgcagattcccaagtcccatcctgcagaaattctgaagcagcaaatccagatgggacctgagttctgaggcacactcagttttaagtaacattacctgtaagtgacagcattgcgattagtacctggagcttccctgggacagaatttgtctcccatcagggcagtacctgaaagttggatcatgtaaccttgttctccaagcatgtcagtcagtattcctgtgtttacacagatacacgccccctacacacacacacacacacacacacacacacacacacagttaacaggttaaacaaaactagctactgtttaccaagggctctgttctgttacttcactgaaatcctcagcaatatgtggtaagtactccaactatccccattttgctgatgggaaaatgggctcagctgaaatcactctgccagggtcacagccagtgaatactgagaacaagagtcaggcccatgcctctggtgtccacagcccactctgccgcttcattcacagctccgatttccttccttgctggccccacgtgtccagggcagccttcccctctgccctgctcccagccttggccctgctgccagccagccgtgtgatcttgagcaagctgcttgttttctctgagcctcagctcctcgcatgaaataagagttggcttggggccgagcgcggtggctcacgcctgtaatcccagcactttgggaggttgaggcaggcggatcacaaggtcaagagattgagacaatcctgaccaacatggtgaaaccccgtctctactaaaaatacaaaaattagctgggtgtggtggcgcatgcctgtagtcccagctaatcaggaggctgaggcatgaacccgggaggtggaggttgcagtgagccgagattgcgccactgcactccagcctggccacagagtgagactccatctcaaaaaaaaaaaaaaaaaaaaaaaaaaaaaaaaacaaaaaggcttggatttaggtttctgatatagaatctgcgggctcccacaggtatttaaaagttgacccttgtgttattttaaatgttttgaaaacggaaactacatttatacaggataatatggctgggctgccaaaaaaaaaataggtctcttttgtttggggctgcagtgacatccactttaggtcttctcctgctcgtcccaacgggcagtcctctgtatgtctttgatgaataagaaatgtgaaaacagattaattattacttaatacttacagtatttttggaaggcagacgctttcggaacagaaccagtggtgttgctgatctcacgctcccttccagctctaacacatctacgtgtgaagctattggcaggacctggcctgatttaaaaaccctctcaaatgcaggcctcatggggtctatctcttatttgcaaggctggctcatcctattagcagaatcagcagaggtagcgactttctaaccccttccgctgtccccatgacaaaccctccctgctgtgagcctccctcgttcccatcgaatttctcaccacttgagcagtggaagagttccccactgttgactgcctcttaccattatctccccaccatcatccccttgtaaatattccttaatattcccagggcactgggacatgctggtctctccaactaatcagactttggcttgactgagatgctgtcccctgctgacatgggggctgaaaatgcagagtgaatgccacggtcaaggccagcactgagtcacgtccgccagattgaaatcaggaccatactcctttcaggggaaggctcacctgagctacccagtaatccgggagcccgtgtggtcctgcagctctgcagacgctgcttctcttttcagtcccccgctgactgtagatggcacttccccacctcagattcactggatctggcctggacaggctttgtttctgttagagctttctagacccttccatcttcagagcatccaaggtctccggtactggctagttatcccccaaccctgggctcctggacgggcctccctgctgagagatgggctgagtggtgggatgagagtgggaaataatgtcagctgctcactactggggggcagggtgcgcaggcattcatctggcactcagctccccctgtcccctgccccaccaccaccccacccacccccagcctgccaggcctactctcatgtgtcctggatctgtgtcgactccctcgatttctctggaaaataggaatcctgagccttgtcaggctgacagctgcttggtgggaggaggcaaaaaataggggcgtctcagttgcattgtccagtgtcaggtggccctgccctaaagaaactcaacatttccctcttccctgggtctttgtcttgctgcttctctctcctgatttctccctcttccctctgtccacttccaaaaagtgcacctggctcaggtctggcctctcacttctaagggatgacagatggagttacatcttcaggagagcccgcctgcagtgaggagcgttggagaaaaatgtaggaccttcacccaagaacagaggtgggagggctggcctaaggaggaggtctccacatactcgagagtgtagagtggggacccggggagaagccacagggtggctgaggtcagctccatgcctgtggcactcagggaccacagtaagctaacatcctcgtgggggagccacacagtaagcatgctaagtagactgcagagtgggcccatcctgagaaatgctcctgggaaacaaaatagagcagggtaaggggaacggagagtcctggcagggtgaggggagacgctgcatttttttttttttttttttttgagacagaatcttgctctgtcgcccaggctagagtgcagtggcgtgatcttggctcactacaagctccgcctcccgggttcaagccattcttctgcctcagcctcccgagtagctgggactacaggcacctgccaccacgccggctaattttttgtatttttagtagagatggggtttcaccatgttaggcaggatggtctcgatctcctgatctcgtgatccgcccacctcagcctcccaaagtgctgggattacaggcgtgagccaccgcgcccagccgagatgctgcaatttaaagggggtggcatttggacaaagatttaaaggtgagcaagtgagccatgtaggggtctagagagtgttcctgcagaacaaacggcgaaggcaaaggccctggggcaggagcctgtcttttgtattggaggagcatcagggggtcagggtcagtaggcaggagtggggtgaccaaagacgagaatactaggagaggaaaccagggaccaggttgtccagggcctataggctgttgtaagacctgtccattttatcagcgaaatgggcacacggttgagggtttcaagcagaagcgtgtcatgacctgacttccatgtttttgctttttttttttcgagatggggtctcactatgtggcccaggctggggtgcagtggctattcacaggcgctgtcactgcggcctacagccttaaactcccagagtcaagtgacccacctcagcctcctcagtagctgggactacaggcatgagctacacccagcagctgacttctgtttgtaacaggatcccaagctgctgtgtcggacacagactgcagggggtaagtaagggtggaagcagaaggaccgctaaggagctagtgtgacaatccaggtgagaggcagcagtgactcaggccacagtcgtgtcgggtgcaggctgtgctgtaccatgattcagaagatggatccaaagggatgtctttgatggtcccttctagcctgataggccccacttccccagggtcgcagatctgggcagaatgccaacttgttgggcccgcacccgcacaggagttacctcttgactgtcccatcatggggtgtgttgaaccttcctattctcagatgtccatggtacatttggggaggtggggcaatgaggaaggattgggagggctgtcacgggttttctgggtgatggggtggcagtggaggacttgaagtggctctgttgagaagcagtgggtgagtcagggccccctgatagactgtggttgcaccatcagcacctgtgcggatgttcttactgctgatgggcagtgaggatggtcccacttactgttcaggtgtccatacgactaaaagggaattgagggccaccgccgtggctcgcacctgtaatctcagcagtttgggaggttaaggcgggcagctcgcttgagctcaggagttcgagaccagcctgggcaacgtggcgaaacaccatctctacaaaaaattttaaagttagccaggcatggtggcacacacctgtagtcccagctactcaggaggctaaggcaggaggattgttttgagcccagtaggttgaggctgtgtgagctatgatcacgccactgttctccagcctgggtgaaaaagcaagaccctgtctcaaaagaaaaccccaaaaaacaggagttgagggcatgtgaattctctgtcggtactaatggttcttggttggaatcattcatacacccacttctgccacggaacttcctggacgtagaggtgattactaagagccggtgtgtgttgggggcttccctcctggctgccgggcactatgttaggccctttacttgccttcctcagtctggagcaccagctctccagggaaggcctcatccttcctcgttgtccagacaaggaagaaggaagccaaggccccgcaaggtgaagggacttcccggaaagcagaggctgctgagcccgcctggagttggagcccaagcctgtgaatctcaccccgcccttgccaccatgcagcgctcctcaacaaagatggttacttaatccaaggtcatcaccagtggatccgaggctgcagcctggcaactggcagtatcagtcacttacaagggtggcaggcaggacccactggcctctggggtcatgacactttgctgatatttccacccagaccctttgtgtctgcgtctgggcctctggagacaccggactgacctggcccagagcaaggtggtacctgcgggtggggttgcttctgatctggaaggagcctgcctctgccctccttgaggacaacgagggccagtgaggggccactcagggtggaatgcccgagcaaaggcctccctcctctcacccatccctgtcctaccagaactgctgttgatttttgcaaaaggcattttctttagaaagagatgctacacacaggtatggtggcttacacgtgtaatcccagcactttgggaggccaaggtggaaggatcacttgagcccaggagtttgagactagcctgtgcaacgtggtgagaccccttctctagaaaaaaaatttttttttaattaagaaaaaaaagatgctgcaaaagcgaagcccctgaggggctgactcaatgaccaaccatcctctggataggcctcgcctcagctgcccgccctgtgaatcaataagcgagacactgtcactccaaatacagcagcctgaaagcaggagtgggatagggctagttagaggagctctctgtggtccgcttgaatgaagaagacgacaccattattcatttcccttttggaaattgtctattcatgtcctttgtccctttttctcttagtgtcctcatatgtttttgaaactgtatttatcatatcacaaatacattaatatgataaatatttcccccagtttgccatttgctttttaatgttttgattttgaaatgtatgctttattttttatattacgtatgtcgagctttttccttttgattttttccccattgctttaatgcttaaaagtccattctcatcttaagacgaaatgtaattaatctatattttgttccagtttttcttagtgttttttttttttattttttattttgccatagtcaaaatcatgtttcctcagccccacctgctccaggaccactgccacctttcatgcctcacatctgtcctcgatttttcctctcctattaagtcctagcatgctgcctcacacctccatcctcatcccctccttggacatcaagggcttctcacaaaccttcctgacccctcccggcatttgcagtcagaagaaccacatacgtggctggctctgggtgtcagagtctggtggagcggagtgtttttcttattgcttctcagggactagaatcgtctgctcaagattctgcatgtccatacttggaaggtcattgattggaagattcccccctcctctctgtccttgcactaaaggcccctacaataagggttgctgttattttagatttcatagtccatttctgttcacctcttttctgatgtcaggcctcctttgctttcaggacaactttttctgctccctgtcatctttggtgggactgccaatcacagtacctcaccccatccttccactcaccgggacagacacacaactctagctaggccacctggcatcttccctgggatgcttcttcaagaaggcgcaaaaggaccccacttgcttttagagctgtggctctagaggactctcagttagatctactaggggtcatcatccccgtcacagaaagccctcgtacctgaaatgaggatgagcccaacacagaaggaagctgagctgagagacaagagcaagagaagccaagaaaaatatctgaagcacctggatccagccttgcctgcatcccgcaatccccaggcttcctcctacataagccaatacagtaccttttaatttgagccccattatgaaaggtttttgctaaagaatcctgattcacccctgcattgcaatgctttggacttcattgtctgcccccctgtaaaactcctaagatgtcaaagctgaaaggggctttagagaccacagtctcatcctgcagttggtgaaacgaagggaaagaacttgtccaaggtcacgtggtgcatcgtttcctgctcaaaaaagaaaaagcttgaactcactgcccagcagcccggacggcgctgtggcctctgcgatggcattgcagtgcttagtggctattgatctgttgttttggatgtgttacccagacaggattgccaccaccacacaagcgcatgtgcagcccagggagagctctagggctgggccagagcgggggtgggtagggcatcgttgctgctgcttcagcccctgtcgggagagaatgagaaaatggtggtgaacaagaccttgctggcatttgctgacactcaccatgggccacgcgccatgttaaatgggcgcagtagctttacatttgttctcagccttgcggcgtccctatgaagtaggtgctacgggaatccctgttctatcagcaggaaaacaggaacttcccaatggtcacactgcgattgagccacgcacttggactaaccagggtcagcctgactccagagcctgattcttgtaccaaggagggggcaaaatcaggcaggacacatggatgagtggaggcccatgcgaggactgtgggagagtgtgccttggctccccagctccggcccagggcaaccaattcaaggcagacttgtcagagcttccagtttttcaagagaagccggaaatctggacttttatgtgaaatgtctcatttttaaatgttggcaaagaaattcagattaaaacacacacacacacacacacacacacacacacacacacacacacacagtgcaagggaacccaaaccacatttgcaagccagcggattgcaacttttcgactttactatactctttctgtggctggaggaagctgttctaacccacaggactctgtccatcacctggcaggagaggggacctacctcgatgtggttaggatgccaccctgccttgctcacactcactcatttctaagtgtgtgtcagaggccagcgaattccagaagcagggattgggcagggcgggcggtggggcatgcgtgcttgccagggagggccaggagcacagaagaagcctccttatccaatgttacaggtgaggaaattgagaccaagtgaggccgtataaacagctgggtccccggtgactcatggaaagagctgctggaaccgggtgcaaggtcttcctgagccataagtatggtcctctgaggacacattaccctgctgttggcctttttggctggtagaggagacacttggattctgggatgtggcagatcccagccttgcccatgataaggataataaggaagtcactgatagtctatgagccccagtttcttcatctgtaaaatgggcatctcctctgtaaaacagaggcattggctctgccccatgccaatgtaaaactatggcacccagtcccagaggggtaggggtgacattcctctcctccaggagcaggggactgagccaaagatacctgcagcccactctgcggtgcctctggggctgggactgttctgggcacgtgctgagttatgatgacacatccagagctgagtctgtctctcccacctgcccaatcctctggggcaggagtgggggtcgggaaggtgaggggcggcttcacttccaggtcaccatccctcagccctgggcctgacacagagaagaatgagcgggaggatggatgaacagcatcataacagcagttctcgtccacaccccccaacccgtgtgccaagctcttagctcacgccatccttcagcccagcagaatcttgtgctgggggtggagccgcagccctgccctcatccattcatcacgcgtatgcaccccttcttttcaggcagtggctcccaactctccccagggctcagagttgcccccgagaccctgacccaggcccagccagggcagctatccccaaacttccatgggacacttggtgtcagctgcctccccccatccttggcctggtgggacctaggggctctcagctacccagccaggagatcggcccccagcagaatggccctacctcagcctgtctgtgtctttgagggttctcagcgcttcacctggcctcagaaactacctctcagcctgagggtccctacaaggctttggactgatgccccctgcctcagcataaatggtcaaggttgagccttatggcccccagaaggcagggctgagatccatagggtgaagccatgggaggcagatggaaaaccttagtgtgaggcacaacttaccatcaaagctgcctacaatggaatgggctttttttaagaggtgagttttctgttcccagagatttggaagtaaaacctgcagccaatggggctaacacacatccattaggacagcggcctcattaaatgactgtgaggttcccttccagttcttagaccacgaatctcctttctagggtttttcttcccagtccaccccctaagacagacacaggccttcgcaggcctgattcagggtggaggaaggggagtcccaggctgaaggcgagttgtttgcaacccacagctgggctcaggagcagggatgctgcaacccagctgcctttctgcagggccttcacctgtcctccaaggaccaaggccaaggctgatatgagccccccatctggcccaagaggttcccacaatggtcctgggtggtgggtcctgccactgggtaggtgtgggagctgggggttgcaggttcaacttggcaaaatgtcaggacacccacgggggcaggcagcttttcaggggcccaaggccatggagctccaaaggagggcagcagggagcacgcagataactgtccccacccagctcccctcccacaggctccacggatcgcactctgtctctctcgcatgctccaggagagacacggcagcacacacacaggcagacacaaccagcacccacatctgagcgctcacacacagatgcgtgtgcgtcgtgcagagacgcccacacggagacacagatacacaccctcccggagccacacagatgacacccacgtgcacgcgggcacaaacacaggccctacctacttgcaaaccaactccacctccagcatggccaccctggctggggaaggaaggccggccgggtgggtgccctggatcagcctccttgccgtgggagtcctgatcatctggaagctatggcctgccccgcccattggaggtctgcagggccaggggctgcccagaggcaacagagtagttccacagggccctggggtcagctgatctggctctggtctcagctttcccaccttctggctctgtgacctgggcaagtcactggacctcgctgagcttcagcgtcctcatctggaaaacaggcataacatagtgccaaccccctgagtcctatgatctctgtagcccccaggcctggaatatcctagacgttcagtaaacagagactgtttctgtcaccccagggcgggggctccattggcaaatggccactcacccattgcagcctggcatttggtgagtgcaccatattcgtgagctattattttcatgtctacttcaaggggctacctggggtctgaactttacttgtggggacccaggatgtaagcctccatgtccagactggcaaagagaaccccattcccctggcaaaggtagggctcagctaggtagtcttaaacaataagcagccactcagctagaacttagactggaatattcgcaatttaataccatggcattccagaccacagctgcaaaaaacagaggctcttgccagtgtgttttagactctcaaagatcttgaagcacaaatctcgaatgtcagagctgtacagaggccttggagacatctagtccagctgtcttgctcctaaaacggaatcccagaagcatggagcctcaaagaactttgagtccattccagaccagttggacagaaattgggaactgaggcccagagagggtgagccactgagcatggttgcacagtgagttagtggaagtgttgagaccagacccctggtcccggcttcatagcaagtttagattcagcccctctatggaggcctggaggaaggaaggcagaagaagaaacatttgggccaaagtgaggattttctggagaactgttttcgaaaaatcaaaccaaaaagaaaaatgggaaaaaggtgctggcttccccttattttctgcctgtcttcctctgggcactctctctctctgcagctctcagccggttccagctctgctcacaagctgcttccagccgcccacgggcttcctaaaatggtctctgcaagctaattccagaggatgaatggcagagagcaggcctgcagggagctggtggggggggggggcggggggggggcttccttagccagtgcaggtgcagacagacgccacattggtgttggaccagctgcccccaaccccaaccccctccttaggtgcttccatggcccccagctgccaggaccagggggcccagctttcacctctcactgcctgacctcttggaataggttatttttccttcttaaagaattaatttttaaaattatgtaataatacatatgtatcatcaaataatcaggaaagtataaagaagaaaattaagatcacctgtaatcagctcctctaaatgaaacaactattaacaattaagcatatatcctttcagtcttaggactcagcacatattacagacagaggggctgattcagtacataatgttctaagtcctgttcttttcttccaatcatatattcacaagcatctttctagtcaacatttgcacttccacagcatgatttttagtggctgcatggcaccttgcatatgactacaccacgctttgctcaaccaatccccaatgcccagcgttttagcttgtgtccatttctcccctgtgagaaacagtacatggtttattcttgtagttacctctttgtaatcaacctagttatttccttaggacaccttcctggaattggaattactggccaaagggtttatacttttttaaaaagataaaatgcaaaattataatactatcctcccttcctataatgaatgtgtaataattaggtaataaataaaaattagaaaatatagataaagaaaaataagagaaaaaaatcataactttccccaaatcttactaccaagatatggttaagaattttgctggaaagcatctagacttttttgtatgtgtgtgcacgcatataatgggattatactatacaggctgttttgtaaaactgatcatttgtttctttctttttttttttttttttttttgagacagagtctcgctctgtcgctcaggccagagtgcagtggcgcaatctcggctcactgcaacctccgcctcatgggttcatgccattctcctgcctcagcctcctgagtagctgggactacagggacccgccatcaggctccgctaattttttgtatttttagtagagacggggtttcaccgtgctagccaggatggtctcgatctcctgatcttgttttccacccacttcggcctcccaaagtgctgggattacaggcgtgagtcaccgcacctggccaaaactgatcatttgttcatgtcaatacataaatttacattcacagtgtcactttctttcttttttttttttttttttagagacagagtctcgctgtgtcacccagactgaagtgcagtgacttaatcatagctcgctgcagccttgaactcctgggctcatacgatccacccacctcagcctccagagtagctgggactacaggaagatatcatcacacccggctaattaacaacaacaaaaaaaattgtagggataaagtctttctatgttgcccaggctggtcttgaactcctagcctcaagcaatcctcccactttggcctctcaaaatgttgggattacaggcgtgagtcgccacacccggcccacggcatcacttttatctgccacagcatatttcattctgtgtttataccttggtataaccactctcctgttttggggaactaggtttctggttttgctccagtataaatagctctgtaatgaacatgcttggaaaagcagctttgcttcttgtccatatgcgttcgtaggctctgtggtagtagaattgctgggtcaagggtttttgttgttgtttgttggttggtttttgttttttgtttgtttttgctgttgatatcacatcgtttctgactggaagtctaaacagcaaaccagcacgcaggctccaccgagttccacagacgtctacgggaagggcccagaatctgtagaaccaggcaggagcttgtgctgcatttcctgctttccaggctgattgcttagagaaaggccttggccttgaatggggcctttgcccaggaagcctcctctgtgcccaggaagccgggatcaaaattagcccccccggaagccaggagcacacaagctggttcctgctggctctctccagcctacttcctgcatacccgatacctcacgtgccctcttcctgtctccagatcccactcacctgagaccatgcacagagggagaatgaatgtgacgtgttacaaagtcctcattgttctgaggaggggagagatgcagccagggcaggcagcctcgagactgggcaggtgtgagcccgggcggtgggtctcagaggtgcatggagggtcagcctggagaggacagaatgcggggccaacccacaggacaaggcccagagcaggaagggcctggagcctgcagaaggcaacaaggagaacaagcccgcagaaggacagggagggcctgcccagagcttccgagggtgctgacggccaggccggcctggacaccgtcttgtctctctccatccttcactgcgctgctctgctctctgcgatctcactccattcagagttgggaaaggaaagatccatctgaggaaaaggtgagctgagaactaaccagaaagagagggagggaacgggcgagggagggagagagaaaggaagaaacagagaagggaggagaggccaccacccaaaagaggaagccatgccatccaggtctcctgattgaccagcacaggtttaagtgaagaccttccctgtggtcagctcagcagtggctgcaagccaggctaggtggctcaggtctgtaatcccagcactttgggaggccaaggcaggcggattgcctgaggccaggagtttgagaccagcttaggcaacacagtgagaccctgtctctacaaaaaaattttaaaaaattagctgggtgtggtggtgcgtgcctgtagttccagctactcgggagactgaagtgggaggatcgcttgagcctggagttaaaggttgcaatgagccgtgatcgcgccactgcactccagcctgggtgacagagaccaagtctcaaaaattaaaataacaataatagtaagaggctgcaacagaccttcaagctgggagagcaggttttcaggcagctcaggaccacaatcccggttctaaaaagtgcgtgcaggcacgtctgacaacaagacagccatgcaggtctgggcgccagctaagagaggagggtcccacattaggttcagccatttcagcttctttccactcttgcctggcattgaattcccgtatttattaatcccctctagagcacaagtgagcccatccttgtgagatgagggaaagcatcagggctgtcctgtgcaaacccagtgcagcacagtgcccaggccatgtgcttcgacactatgggcagctgccgaggagacatctctttgagcaaagtctctctgttcatcaccctccccctccccagttccctttttgtcacttgattcaggtgggattcacctctccgtggcctctcctctctttccttccccacctctgcactctgggcctgctgggaacggaggagagatgggtgggccatggtgtgcttcgttcacaaacacccacccagcacccagatgtgactgggggaggctgggtgggcaatgacctgtgagcctgtaggccaccccctttcacccaggggacagcttctgggagcctgaggtcgggggtcttggagaaagaatagaagcacacccttggctccttcaggtgggggttgggtggagtggagagcagggctcttgcctgaacagtaatatcataaaactgtgaagagctggccgggcatggtggctcacacctgtaatcccagcactgtgggaggctgagatgggcggatcactgaggtcaggagttcgagaccagcttggccaacatggcaaaactccgtctctataaaaaatacgaaaattagccaggcatggtggcgcactcctgtaatcccagctccacaggagactgaggtaggagaatcacttgaacccgggaggcagaggttgcagtgagccgagatcgtgccactgccctccagcctgggagacagaacgagattccatctcaaacaaacaagcaaacaaaaaaaacaaaaaacacaaaatactgtgatgagttgacatttaagtgcgatcagtatgcgcctggaactgtcgagctggtaccttacttatggtcataggaggtgggtgccgtcatcatccccattttatagatggaggaaacaaggtgcagaggttgagtaactggcccaagatctcacaaccagcaggtggcagagctggatttggagcctgtgattgtcccacccagctaaagtctaatcaggctttctgtcctccaagctctgagaagccatcctcggcttcccagaacctttctttccttggtctgagctcccgacccaccccctgtctggactggagagaggaagtctggaagccacccagtctccatccagtaagaacacgctcctgcccactgtggccccagtgcctacacaagtgcctgcaatatagtagctgctcaataaagatttgctgaacaagggccaggcttggtggcatatgcctgtaatcccagctacacaggaggctgaggcaggaggatcacttgagcccagaagtttgagaccacacattgagaccccatctcaaaaataaaaaagtttgctgaacaagctctgccctgtgtagctggtgctgggactcacagcgggcctgcagcagtcaagagagaggtctggagccaggctgccctgtccggtcccagctgtgtgttgctgggcgagtcgccgcatacctctgggctgcacttctctgcctgtagaaagagagattccccagtgcctgcctccctttgtggggccctgaacaaacgctccatggagacgtagctgctgttattattgctgccattacccagggacaccatctgtattcgaccctggggctggcagaacgtggttctctcccccactgcccctctcctgatgctactggaagcctgcgggggtgtggggagcctggcctggcccaggtcctctcctcacccgtgtcaggaaagagaccctgtctgcacctgtccccagccccagccccagcccagctgctattcttagtccctccccatttccctcatctctaggcattttccctcctaaacttgctctgcgtttccataggaaccaggggagggtggagatggggagagggtcctcccccacggaagggaacttcatttggggctgtttgggagcggctggcagtgcctggtggaacttcccccactgtgcctctcccctcctccccagacccctccttgaacagcctgttcctccgaccgttatttttaatgcatttatcctgccgcttaatttatcccgcattgtgatcagatttagctgagagcgctccgcagcccggcctgcctgcatattcatgagtcggttcattcatgccgcccccagaatgccgggcaatagtgggcagtgcgctgcctggtccccgggtcccacctgctgcaagggcaaccgggggtcagaggtcaagggcccaggctgcagccagagagcggttgtagggtacagcacctgtgggtagggggtggggggtgtccctaggtggaggctctggagccaaactgtgctaacatctttctctgccattgctgataaaatcacttcacttctcagtttactcatctgcaaaaggggaaaataatgtcccctgccctgggtcactggaagattaagagaatacacataaatgatcacagtgggtattcagtgtagctccctgttgtcattgtcgttcctgctgagcagtggttcatcgtggctctggttcctggagaaacggggtggtgggctggggcatgagtctcctctggtgatgaggctgtgggctatttctgtccagcctttgctgactgtgatacgagctcctcccctcaagtgagggtcaggagggcagttcccaaaaggcaggagggaccagaggatgcagtctggtctctcaggaagggcccctgggatcgtccagggtgtgcagcccccaccaggggccagcagggaggctggggctctggaaggaggcagggctctagactccaggttcttctggcccttgggaacttctaggttgatcactcccttcaattattcattctgttattttactgttgccaagcccatgctgggctctggggacatcgccctgtcctcagggggactacatcccatcagagaggtgagtccaggctacggagtggtcagggccttcagatgaggccagatcaattgcctgggggttcagaaggggaggaaatcatcgcagctgggcatcagggaaggtttcctgtaggaggcagcatttaggccgaaccttgaaaatgtggctgtaacaagattggatggagtaagatggatatttggggtctaagggacagcaaaggcaaaggctggtgatgggaacgcaggttgggagaggtcagccaggtggaggctgggagattcctgagccccaggtgagggggtcccaacttacatcagccatcccccaaggtgggagccagaagggccttacctctgtccctcacatgtgtgtgtgcacacaggggtcacattccagcttgctggggaaaagagaagagctcctgcctgggtctcctgattaatctataattaaatcagcacggacgccacggaaccatgttgtcattagagagctggtgagggcagaccgggatttccctgggaaccgggaggcctgccgggtggctgcagcccatgccatgaacagatggccttcaggggtgaggagcaggaacgaaaggccagagcctcagccaggagtgagaaaaacagcagcttactcttggccatttacagtgtttctgtcactgtcttggttaatcctcatgacatgccatgggcgggaccaggcggggtattattatttactcgcattttacagatggagaaactgaggtgtagcgagccaagggatgagccagcctggatccttgggttttggaatcagagaatcgtgggtacgaaattctcttgccagctgtgtgctctcaggcagattgcttaccttctctgtgcctcagtttctccatttgtatattggggacaagaccctatcacttcaaagcattgcttaaggattgaataaggcagttcacataaagaacttagcacagtgcttggtgcttggcaaatactcatcaaatgctgctacttacacttcactgtaactgcttctctcttgtccatctttcttaccagaatatgggctccatgaggatagggactgtctgtcttgttaatttcatagtgttcaataaattactagtatgtgagacagcctttcgtaagctgcaaaatgctaaaacattagatactattttctctatgttctgccttgctttctctatgttctgccttgctctaaaaaggattcaaggagacaagtattaatattattatctttgttattatcactgttatgtaccaactctgttactcagaggtggttcttccttaaattaatatagaaaaaatctaggccgggcgtggtggctcatgcttgtaatcccagcactttgggaggcagaggtgggtggttcatttaaggctaggagttggagaccagcctgggcaacatggtgaagcccagtctctactaaaaatacaaaaattagccatgtgtggtgatgagaaggaaaaggagaaggagaagaaagaaaagaaaaggaaaagaaagaaagagagaaagaaaagaaagaaagaaagaaagaaagaaagaaagaaagaaagaaagaaaaagaaagaaagaaagaaaagaaaaaagtctagaaatagtcaaggagcctcaattcataggtggccgctaagaggtgaggcagagacctggcttctggagggaacatctagagacagctgcagaaacctctgggccaaccaaggagctacagcctgggaggccctggaagaactccttgctcttgtaatttgggaggctctggattttcagcaagaccagaggggctggaacctgcagcccactggctgcagattagatctaaggaatctgtctttgaagagcgagagggcatttggggatcatcattatctccgtggcacagtggtttccaccccctccactgggaactgaggtttcttacacaaataactgttaaagtcccagattcccaaatgagttactttaaatacgatcaattagagcagattcaaagttatccctgagacagtgtggccccatgcacctacattcttgagtggacagtgaaggaccagagctgtctgttgttcacagagcctctcttgcctcgagcccctgaggaacgatgactgttggctgtccctcacctgtggacatcacattgtagcacaggctgctgtgtcctgcccacattcccagaggtgcctgccagggctccctgtgactctcagcccgagactctgcacagagcccacttctctagaagtaccaagactcgattcccccggagctgccctcgagcaaggggcctgggggacggccaagaaggacttccttgcacctcaatgagacagtcacccacagcggcagctcctgtctccacttccctccctttcctggctcgttccccttgttccaagtaaactacttgcacccaactcctcatcccaggatctgcacttgggggaacccaacctaagacacactccaaaattataggtgctttattgtcctgcaggaatttttgagaggtgtccaaacctgtggatactcctgggagggcatccatcatatgagctctgagggcacctggggcttggtcgggtcagggtcgggggagcagtggtcagcagatggttctggtcaatagaggctgacgataaatcgaaagcctcccctcaatgcttcgcaggagcaggtgcagatcctgaactgaggactctgtgctgaagcagggaggcacctgatttgtttggtagtcaccaattaagcacctactgtatgctgaggataaaacaggtgaatgagatagcaaccatccttgtccctggggaggtctgagtctactggggaagagagtcatatcaacacatggatcaaggttagagatgagtgaagaacttcagaggactctggtaaattcatccattcatttaaggcatttattgagcacttatggcatataaggcaccgtgttaggccttgtggatgaaagagataggctatcatcacactactcagaaaggagacaaggtaacatctgacatttattaagctcctactactgtgtgcaaggcactgagtagggtgctttccatagtttatctcattcccttttgtttgcttgtttttgttttgttttgttttgtttatttatttatttattttgagatggagtctcgctctgtcacccaggctggagtgcagtggtgcgatctcagctcactgcaacctccacctcccaggttcaagcgattctcatgcctcagtctcccaagtagctgggattatagatgtgtaccaccatacccggctaatttttgtatttttagtagaggcggggtttcaccatgttggccaggctggtcttgaactcctggcctcaggtgatctgcccacctcggcctcccaaagtgctgggattataggtgtgagccattgtgtccagccttgttttgtttttttgagacagggtcttgctctgttgcccaggctggagtgcagtggtgcaatcatagctcactgtagcctcaatctcctgggctcaagcagtcctcccacctcagcctcccaagtagctgagactacaggcacgcaccaccacatccagctaatttttgtattttttgtagagatggggtttcaccatgttgcccaggctggaatctcatttcttatcacaacaaatccgttatgggggtaggtagctattcttatccccacacagagaagaggccctgaaagttgatgcaactcacaagaccacatggctgggaagtggcagagctgggcttcaacctagatctgtcggattcccaaccccccatactattttttccctcgcatcagaccacggtctgtggcttttgtcttaaatacccactgagtgaaccagtttttaaaagaacaaaacctggaagcaaaccaggccaggctcagatggagctagaacaagcgtttgctggggtcaagctcccgctccgaggccctgcctcatctacagggggcctaagcctggtctgtgacccctgtctgtagggaatccaggacacctggaagctgacctcatttcaccctgaagagtcagggaagggaggctcgggagaggccctgctccctgtgcccagtgggcctcccatgtggactgatacatggttcagcaaagcccagaccctcccaaccacctccccaaaggtagtcaaggcagagcctggctgctaatgggaggatgttcctgttattattacaggaaaaaaaaaaagtcagtctaaatcttagtggcttaaactaacaattttgctacgtttacagactctgtgggtcaagaatttggacaaggcacagtgggggtgtgagctccatgatgcctcgtgtctcacctaggaagattcagtagctggcggcaccatgacagctggcagctggaatcatctgaggatcatcacccacgtgtctggtgattgatgctggctgtcaggtaggacctcagctgggctgtcagccgaaacagctacctgtgtgctgtctcttcctgtgggctagtttgggcttcctcccagtatggcagctgagttctaagggcaagctgggttctaagggctctcttcccaaaagagccaagtagaagttgaatcgcttttatgacctaactttggaaatcacatagccttgcatcacttctgcaagagtcacaagtccacccaaattacagagagggggacacagacctcacctctcaatgggataacatatggaattggagatactgttaaggacatctttggccacataattaactaccgaaaacagtagggaggaattggctacccaggtgtgagttgttgcctcaagggtggaggggcagccagcattgaatgagagccagtctgaatggatgacagggagagcagtttggattgaggttgacttctgagatccaggcaacaaggccagagataccaaggcagaggttcagctggacgcagaggaacaagcattgttttatttatttacctactacccctccatcagtctggccacctggtctcccatctatctattcatcaatccacacatccatccatccatccatccatctacccatctacccacctatccattcatcctccatccacccacccacctatccatccattcatccacctattcatccatcacccatctatccatttatccatccatctatcctttcatccatccatttattctacccacccatgtatcttattcactttcactatgactcagtttcctcatctgtaaaatggggatcgtaatataaacctcatgggattgtttgaggagtcaatgaattgataaatgtaaagtccccagcacatattaagagctcgataggcttggcacggtggctcacgcctgtaatcccagcactttgggaggccaaggtgggcagatcacaaggtcaggagatcgagaccatcctggctaacacagtgaaaccccgtctctaccaaaaatacaaaaaaattagctgggcatggtggctggcacctgtagtcccagctactcgggaggctgaggcaggagaatggagtgaacccgggaggcggagcttgcagtgagccgagatcatgccactgcactccagtttgggcgacagatcgagactccgtctcaaaaataaataagtaaataaataaaaataaataaaaaagagctcgataaatattatcaatttttattaacattagtatgattcttactgttattcaggcatgtacccacctataaatctatcttcccatccactctcccattcatctgttttttttcatttattcagtagtacagttaaccatatgcacatttaatttacatgagttcaattatattcttagcaataaagaaagacagaaaacgaattttaaaagcacagttgacttttcgtgccatttttgtacaatgggtgtgtggcccagaaggagtatgaggtgagccatgttactaattgcggggttggggtgagagcaaaaccacgtagctgcatttctggggcagtttattggattttacagggtaattttaactgttcatggttcatgctgactttcctaccttttagatggcatgggacccacctctctgtgatgtgctctggctggctcccagcagcacagatacagtaggacctggtccctgccctcaatatactcacagtgcatggcacgttcagtggcacagacacataaacagaccatgatggtgtagtataaaaaattcaagctggagaagcactgtgggcaaatgactgctgtgaggagggcaaaaagagcagcagggaggcctttgtgagtgtgtgacatttaaacaaaatcttaaagcttatgagcataaattctcaagacactcaagaaggagaagggcgcaccaggcggagggaacagcacgttatgcagagagatgaaagatcacagggtgtggagagaatggagagcagggtgggagggcaggagtggagggacataagtctggaggtgtcatcggggctgatctgaaagggcctatggtaccaagccaggggatcttgggctctattctgcaggtggcgggcagccgtggagaggattaggcagaggagaggtagggtcagagttgtgttttcaataaatcgctcctgctgctgtgtgatggttgaacaggaaaagaaaagtctggaagtacagagaccagagagggaggctgagccccacccggcttctattgagttctgggacggtggggctaccacagaggaggcctgaagacagtgaaccaagggccccgttattgggcaaatttaccactttgggcttgagattcccaatatatggcctcacaagtgttttaagttgaaggagcagatggctctcctcagggtcagctagagggcttaggttctgcaccccataaagtctgcctggggctggaaagggctcttcactggatatatagtgtcgttttattgttttttgttttgttttgttttgtttttttcttttttgagatggagtcttgttctgtcgcccaggctggagtgcagtggcgacctcggctcactgcagcctctgcttctgaggttcaagcgattctcctgcctcagcttcctgagtagctgggtctacaggcacgtgccaccatgcccagctaatttttgtatttttagtagagacggggtttcaccatgttggccaggctggtttcgaacttctgacctcaagtaaaatgcctgcctctgcctcccaaagtgctgggattatagatgtgagccactgcgtccgacctgttgtttgttttttaaatttatctcccttagggttcattttgactcctgaatctgagggttcatgtctttcatcagttctggaaagttctttgaatgctacctttcgcccattctctcaattatctcttcttggaactcgaagtagaggttgtcagacctttttcatctatcctttgtgtctgtcttagttttccctccatttctttctgctgtattctggacaatttcttcagattccaagtcacattttttttctcttcagctgaggttaacaacctgttgtttaacacttctaagagttaaaaattctaattattgtatattttttatttctggaagtttggcttggttctttttcaaacctgcctgttctttctgtagcatccctcactgcatattcattgtttcaagctcctctattctgtctgtaaacacatggaatatatttactgtattttacattttgaatcctacaataccaatatctgaagtctttggggatctgactttgttgtttgctgtttcttctgttttgctcagggtggcatgtctcttggatgctttgaattttatttttattttcagttggacctatgggaatttcactgaggaccaggctgaaggtgttttcttccagggagagtgcaaaacatttaaattgaattgttattgaggggaacatacaatagagtgcattaatcttaaatgtacattttaaatggatatacatccccataaccatcatccagatcaagatatagaacgttctcagcactgcagaaagtttcctcatctccctttccagtatacctgcaccccgagagggaaccccattctaacttctaccaaatcactgatgagttgtgaaatgatatacaaatgaaaccatatagtacattttcttttcttgttttcgagacagggtctcactctgtcacctaggctggagtgcagtggcacaatcacagttcattgcagcttcaaactcctgggctcaagcaatcctcccacctcagcctcccaagtagctgggactacaggtatgcaccaccacactggctaatttttaaaaattttttgtagagatggggtttccctatgttgcccaggctggtctcaaactgctggcctcaagtgatcctctggcctcagcttccaagtgtgctgggattacaggcatgagccaccttacctgactgtagtattctttaacttgatgtatatctgtgagatgcattcatgttatcccatgtggtgatactgtctttattttcatttctgtgtagtattccattgtatgaatatatcacagttgggttttccattctcctgatgaggtctccaagttacatttgggtaatttctggttaggaactatgatgaataaagtttccatgagcattcctgtatatttcttttggtgagcattgcatttatttttatagggtaaataccccagagtgaaattactgggtgatggaatatatggatgtttggctttagtagaccctgccgaagttttccagggtggttgtgcccatttactctcccaccagccgcatatgaggattctgattacatccttcccagcacttggcattgacagtttttaacatttgccattgtggtgggagtgtagtggtatttcactgtggtgttaatttttattttcctgatgattaatgatgtagaatacctttccatgtctattggctattttgacctatttgatgtagtgcagtctgttgcctccttttttctgaactcaattaagtggaattcactgcaaaggtaaagtggcttatattccaagttatgtaacacctccagcacagtgtagggcagtgatgtgctggcaaactggttctcagaatttttttttttttttttgagacaaggtcttgctctgtcttgcaggctggagtgcagtgacacaatctcagctcactgcagcctcaagctcctaggctcaagcaatccttccacctcagcctcctgagagttgagactacagggtgcgctgccacacccggctaatttttgtatttttatagacagggggggttcaccatgttgcccaggctggtctcaaactcctgggctcaagtgatctgcccgcctcagccacccaaagtgctaggattatggacatgagccaccgcgcccagccagattggccagattttttttagtagcctgatttgcagtattttctgatttctatgatatacatacttcaaccatagccaatttcaagctactgaatggcttgcaaaactcctgaatatttaacaaatggctcccatgagccaggatggattggctccaggataccactgcgtctagggtagcacctctaataaaactaattgatatttctgcagcaaactgtgtaaatattcacactaattggtgtaaaacatcttcatatccattgaggtcagatttttgcgtgcaaagaatcaaccatgaattaactgtaaaagaaggactttcagttgagaaagatctttggattttcacattgcacgtaaaagatagtgggtctgtttctgcatggattccactgtctgcagatttgctgatactgttgggatccttcgggaaatcctggtgacctttgtgaacagcagtgaacaatgattttgagctcagtgatgtccaaggtccctttagttctagaagtctatggctaaaaatttaagaaatatttcactaactgcccatttggctttatttctattttagtactactgtgggctggagtcttttaaaacatggtttctggagccatggagagatggtttctggtaaacccagcgctcgcatggtccttcccacagaaggttctggagtcaggctgcctagacttaaatcttggctccaccactggcttgctcttggatttggggcaagtcatgtgaaatccttctgtgcctttgtttcctcactgatcatgaaaactgaagtgtgaaaaaaggtggaattcctgaggcccatctctgggctgcccactgggggcttcctcagacacaggaccccagatggcattgagcatcttgagtcagccagcgttggccagtggaggggggcagtttgcagtggccacaggagaatcttactccacacgacttagtgccccggtgtttccccatcttccctgacgcagcttctttgtcagtggcgctcaggcccaaggcccatcccttcctcaagaaatcctgctcctacttgaggaaacttggcatccagggcctcccccaaccctggcaacagttcggaatccaccactgtgagatatctcagacctggtttcttgagtcttttgcttcctgtggggcctgtccggagaccctgatttagatctcgcctctctcccctccctctagaggcagtagaagctgtgaccaagctcatgctttgtgtcctggaccgtctgggccaagagaaggccacctgccggaggcagggccagtggccactcttgttgggttctcatcattaaactgttgttctgatgcctatttgtaaaattgggttgtctgtcttgttcctgtaggttcctgggagctcttccgtctggctatcagccatcagttggatacctatattgaaaacataatgtctcctagtctgaggcttgtcttttacctctcctaaatgaagagttcaatattaatgaagtctaatttatcattattttcttttatcattagtggttctttgtttgtttttgtgagacagggtcttgctctgttgctcaggctgagtgccgtggcatgataacggctcactgcagcctcaacctcccaggctcaagtgatcctcccacctcagcctcccgagtagctgggactacaggtgcacatcaccatgcccagttaattttcatatttttttgtagagatggcgtttcaccatgttgcccaggctggtctcgaactcctgagctcaagtgatcctccttcctcagtctcccaaagtgctgagattacaagtgtgagccaccatgctcagccactgtttcttatatcttttaggaaatgaagatatttattcatattttcttctagaatttgtattgtttttgtttccacatacagatctatgaaattgatctatcttgcaattaattatatcttcaattaatttttgtgtatggtgcatgataagagtcaaaattcctttttgtcatatggatatctagttttggtggcattatttattgaaaagaccaccctttcccccactgaatttcaggatacatcatgagccaggtgacatggcatgggtccagttttggactgtcgtcagtacttcgatctatttgtctttgcactaatgcccactgtcttgattactatagttctatagcttatttttatttaacctttttgtctcgagagaattgtagatttgcatacaattgtaagaaagaatacagagagatcccacattccctttacctggtttctcccaatggtaacatcttgcaaaactctagtataatatcacatctagaatgttgatattgatgcggccctctggtctaattcagatttccccagttttacctgtattcatttgtgcatgagtgtgtgtgtgtgtttagttctgtacaattttatcacctgtgtaggtctgcgtatccacacagagtgaagcttcagaacactttcatcaccaccagaatctcgtgtttcccttttctcagccacacccgccacccttccacattctctctccaccctactcctaaccccaatccctgacactcactaatctgttctccacttctgtgtttttatccagaaatgttatataaatggaatcgcacaatagcttttcgggattggcttctttcactcagtgtaaattcccttgggatgcacacggtggttctgtgtgtcagtagtttgttcctttttattgatgagtggtattccatggtgtggatgcaccagtttgtttggccattcatccgttgaaggatatctgagttgtttccagtttggggttactatgaatagagctgctataaacaatcatgtgaacatgatttttgtgtgagcataagtttctatttctcttggataaatgcccaagagtgcaatttctggggtgtatggtaattgtatgtttaggggtttttttccaattggttttattttgtagagccatcttaaattcacagaaaaaattgaatggaaggtacagagagttctcatatacccccatccctacatacgcagagcctcccccacctcaaaatcccaccaccagagtggtacattcgttatcatcaatgaacctaaattgacacatcattatcacacagagaccatggtttacattagggttcactctggtgtacattccatggcttttggcaaatgtaaaacgacatgtgtccctcattacagtgttattcagatcattttcgctgccctgaaaatcctctatgttccacccactcatccctctctacccccaacctctggcaaccacctgatgcttttactgtctccataattttgccttctccagaatgtcatatacagctgacacttaaacgatgcaggaggcaggggtactgaccctttgtgcagttgaaaatctgagtataacttttgacccccaaaacctaactactaataacctactgtttactagaaagaagccttactgataatgaacagttgattaacacctatgttgtatgttatacgtattatatactgtattcttacaatcaagtaagccagagaaaagaaaacgttattaagaaaaatcataagaaagagaaaatacatttactattcattcagtggaagtggataatcataaaggtctttatcctcatcatcttcacattgtgtaggcagaggaagaggagcaagaggaggggttgatcttgctgtctcaggggtggtggttcatgtgtgagttttttcaaattattgcaaatttcaaagttgtccaatatatatatatttaaaatccacatataagtggacctgtgtgattagaatctgtgttgttcaagggtcaactgtagttgaaatcatacagtaggtagccttttcagattggcttttttctcttagtaatatgcatttaatatttctctatgtcttttcatggctagatagctcatttctttttagtgctgaataatatttcattgtctgaatatagcacagtttacttgtccactaacctactgaaggacatcttggttgcttctgtgttttggcaattattaataaaactgaaatagactttcaagtgcaagtttttatgtgacataagttttcaattcatttgggtaaatactaaggagcatgattgctggatcagatggtaagagtatttttaattctgtaagaaaccaccaaaccgtcttccaaagtggctgtaccatttgcattcccaccagcagtgaatgagagttcctgttgctccatatcctcaccagcgtttggtgttgttagtgttttggatttttgccattctaataggtctgtggagtggtatcttactgttgtttaaatttgcaattatccaatgacatatgatgttgaacatttttcatatgcttacttgctatctgtatatcttctttggagaggtgtctgttaatgtcttttgcccagttttaagttgggttgtttgttttcttattgttgagttttaggagttcttcatgtattttagataacagtcctttaccaagtatatcttttacaaatacagtcatgcaccacataataatgtttctatcaatgacaaaccacatatatgaaggtggtcctatgagattataatggagcttaaaaagtcctattgcctagtgacgtagtagatgtcttaatgttctaggctgacacattcttcatgtgtttgtagtaatgccgatgtaaacaaacctaccgtgccgccagtagtataaaagtctaacatatacaattatgtacatttgaccatgataataaacaactgttactggttatgtatttactatatcatgtttttattgttattttggagtgtacttctaccattaaaaaaagtttacttaaaacagtatgccatggtatgctggcagcagctcatgcatctcatgtttatttttgtacagctgtacaatgtgtttgtgttttaagctaattgttattacacaagaggcaaaagttttttttgtcattgttttgttttgtttttaagacggagtcttgctctgttgcccaggctggagtgcagtggcacaatctcggctcactgcaacctctgcctcccggattcaaagaattctccctgcctcagcctcccaagtagctgagattacaggtgccagccaccatgcccggctaattttgtatttttagaatagacggggttttgccatgttggccaggctggtcttgaactcctgatctcaggtgatccacctgcctcggcctcccaaagtgctaggattacaggtgtgagccaccgtgcccagccaaaaagtattttttaagtttaaagtttataaagtaaaaaaggtacagtaatctgagttgagctcttgctgcattttgagagttctttgagagttctaaggttaatttattattgaagaaagaaaaatattttttacaaatttagtgtaccctaagtatacagtattcgtaaattctacaatagtgtacagtaatgtcctcagccttcacattcattcacacctcactcattgacttacccagagcaactcccagtcctgcaagctccactcatgataaatgccctatacaggtgtaccatttttaaatcttttacaccatgtttttactgtagcttttctgtttagatatgtttagatacacaaatatgtaccattgtgttacaattacctagagtatacaatactgtaccatattgtacaggcttgcagtctaggagcaataggctataccatctggcttaggtgtatagtaggccatagcgcctgggttggtgccagtatgctgtatgatgttctttgcacaaggacaaattcacctaatgaagcatttctcataacatatccccatcattaagcaatgcatgactgtatttcctcctagtctgtggctcttcttctcattctcttgatattgtcttttacagagcagaagtttttaattttaatgaaacccagcttataaattatttcttttatgtctcatgcctttggtgttgtttgtttgtatctaaaaagtcattaccattcccaaggtcatgtaggctttatcctatgttgtcatctaggactttaatagttttgtgttttacatttacgtctatgagccattttgagttaatttttgtgaaaggtgtaaagtctgtgtttagactctttttttttttttttttggcatgaggatctccagtttttccagcaccatttgttgaaaagactcgctttgttcctctgcattgcctttgcttctttgtcaagtatcagttgactatacttatgtgggtctatttctgggctctctattctgttccattgatctgtttgtcttttctttcaccaatgaccacattgccttgacaataatagctttatagtaagtcttgaagctgggtagtatcagccctccaactttattcatcttcaatgttgaattggctattcttggtcttttgcctcgctgtgtaacttttagaatcagtttgtcaataccctcaaataacttgttgggattttgattgggattgcattgactctatagatcaagttggaaagaactgacatcttgacaagattgaatcttctatccatgaacatggaataacattccatttattctgttctttgatttctttaatcagaagcttgtagtttttctcatatagatcttgtacatatttttgttagatttatacctatttcattttggggatactaatgtaaatggtattgggcttttaacttcaaattccacttgtttattgctggtgaaagtaattgatttttgtatattaactttgtatcctgcaaccttgctataattgcttattaattcccagagtttatgtttaattttattttttaaaaacctgtcatactgttttctagaggggctgtaccactttacattcccactagcagcatatgagtgattcagtttttctgcattcttgcaaaatctggtgttgtcactgtttttcactttagcaattctgataggtatataatgctatctcattgtgcttttaatttgcttttcctgatggctaatgatgatgaacatcttttcatgggcttatttgtcatcagtatatcttgtttggtgaaatgttcactaatgtcttttgcccattttcttattggattgtttgttgttgttgttgttgttgtttaaattattgagttttgagagttctttatacatcctagataccagccctttgttgtaaatattttctctccactatatgttttaatataccctgaaatctagtaatattagtcctatagcttcatgctacttcttcagtatagtctctgcagttgaaagtccgttggatttcatataaattttagaatgagcttatcaagttcccaagaggatgttaattgggattgggatctatagatccatgtgagaagaactgacatctttcaaatcgtgaaaaagtgctgggattacaggagtgagccatcgcacctggccatatttgttgattttttttttttttttgaaacagattctcgctgcgaacatgatatatctccccatttattaggttctttttttcatttctttctgcagtgttttgtgattttcagtgtaaaagtcttacacatctttcattagagatatttctgggtattttatgggttttggtgatattgtgttgtctatttaaatttctttgtttcggccaggcacagtggctcatgcctataatcccagcactttgggaggcccaggcgggtggatcacctgagttcaggagttcaagaccagtctgctcaacatgatgaaaccccatctctactaaaaatacaaaaaaattagccagatgtggtggtgggcgcctgtaatcccagctactcgggaggctgaggcaagagaattgcttgaacctgggaggcggagtttacagtgagccaagatcgtgccactgcactccagcctgggcgacagagcaggactctgtctcaaaaaataaataaataaataatttttttgtttgttgctcatatgtaaaaatacaaataatttttgaatatttgtttgtgtatagagactttgctaaactcacttattaactctaatagtttgtagattcttttggattttccacattcacaaaatgtcatctgtgaataatgatatttttattccttcagttccagtttgtacattttttctcatctttttgcactgactaggatctctaatacaatgttaaataaaaataatgacagtagacagttaatctaaagggaaaagcattctaaatgtttttcaccaataagtgtgatgttagctatagggttttataggtgcccattataaggtaagagaagaccttttcagtttctagtatggagaatttttattttgaatgggtattgaattttaccaaatgttttccacttttttaatttttttcccacattttttgaaatgatagttttttagaatatttttgaagtggtgaattatattggttttttggtgcagtggcaagatctcggctaactacaacctccacctcccgggttcaagcgattctccatctcagcctcccaagtacctgggactacagacatgcaccaccaagcctggctaatttttgtatttttagtagagacggggttttgccatattggccaggctggtttcgaactcctgacctcaagtgatccacctgcctcagtctcccaaagtgctgggattataggagtgagccatcctacctggccatattggttgatttttttttttttttgaaacagattcttgctctatcgcccaggctggagtgcagtggcgagattctggcccactgcaacctccacctcccaggttcaagtgattctcccacctcagtctccccagtagctggaattacaggcgtgtgccaccatgcccaactaatttttttgtatttttagtaaagatggggttttgccatgttggccaggctggtctcaaactcctgaccacaagtgatctgcccccactttgcctcccacagtgctgggattacaggtgtgagccactacgcccggccatattgattgatttttttttttttttaatggagatggaatctcactctgtcacctaggctggagtgcagtggagcgatctcggctcactgcaatctctgcctcccgggttcaaacaattcttccacctcagtctcccgagtagctgggaccacaggtgcatgccgccatgcccagctaactttttgtattttactagatacggggtttcactgtgttgcccaggctggtctcgaaatcctgagctcaggcaatccaccctcctcagcctcccaaagtactaggattttttattttaaaaatccgatttttgaatttaaaagcaacattaaattcatgaaataaatcacatttggtcatgttgtattgtgctttttatatatctctagatttattatgttaatatttgtttagtatttttgcatctacatttatgtagatattggcttataatttttcttttttgtaatgtaaagtgagtcaggaaatattcataaattgagtcaggaaatattccctcctttactattctctagaagaatttataggattaatgttctttattctctaaatatttgggaaaattcaccggtgaagccatctaggcttagataatttttgtgtgtgagaaggctttaaattagagattcaatatttaaaaataggtatagggctgttcaaaatttttatttcttcttgtatccttttggtaagtaatgcttttcaaagaatttgtccattacaattaaattatccaagttttggcataaagatgtttacaatattttcttattgccttttaaatgtctatagtatctatgggtgcagagctttgggaggccgaggcactcagatcacttgaggtcaggagttcaaaccagcctggccaatatggtgaaaccccatttctactaaaaataggaagccgggcatggtggtgcgctcttgtagtcccagttactcgggaggctgaagcaggagaattggttgaacccaggaggcggaggttgcagtgagccaagattgcaccactgaactccagcctgttggacagattgagactctgcctcaaaaataaattaattaattaattaaaatgtctatagtatctgtagtgatgccctttcttcattcttgatgtttacaacttatgttatctctctctctctcttcatgatccttttcaacgaaccaacttttggctttgttagttttcagatccatttaaaatggaattctgaggctgggcgcagtggctcacgcctgcactcccagcactttgagaggccaagatgggtagatcacctgaggtcaggagttcgagaccagtctggccaacatggtgaaactctgtctctactaaaaatacaaaaattagccaggggtggtggtatgcgtctgtaatcccagctactcggaggctgaggcaggagaatcgcttgaactgggcaggcagaggttgcagtgaaccaagatcacgtcactgcactccagcctgggtgacagagggagactctatctccaaaataaataaataaattctgagcttgaattttttggtatcacataaatatttagaattcaggccttgaatccatgtgagggccagtcagtatccacaacttctcagaggttactcctctttaatcccacccagacccaaagctgagacagatcattttctttgctgtctgtcttcatggggcaggattaaaaaaaaaatcacgcctttcctgagtccataatttatgtagggtgagctctgactcatttggctgtctgtcctgtacaggttgcaggctttgtattacctgagttagagatgtctgcatgacatccacaacgccaatgtaggctgatctctcaggactcatattcctgctttgtttctggcacaagagaatttctctactttcttgaagacttattcatttctatataatgtttaaaatctatagcatttgacagtggtgagaacgtagtatttctcaccttagggtgtttgtattgctgttccctccagctggaatgcttttcaccgagatatctgcagggctgcctcctttgctctgttcctcacaccttaccttctcagtgagtcctaccggacttccctatttaatcatcttcatcaactctagcaccccctattccccttaccttctctgcttttcctttttttgtttttgtttgctttttttacacagggtcttactgtgttgcccaggctggaatgcaatcatagctcactacagcctccatctcctgctctcagatgatccttctgcttcagcctcctgaatagctggggctgcgggcacacaccagcacacttggctaatttttaatttttttagtagagatgagatccggttatgttgcccaggctggtctcaaactcctagactcaaacgatgctctcctcccaaaatgctaggattacagacgtgagccaccatgcctgtctctttcctttttgtcatagaacttatagccatctgtgtcatttactgatttatcatgttttttgtttattgaccagttccttttgctagatgtaagcttcatgaaggcaggttctttatgttttctttactccaaattcctaaaacagtgtctggcacatagcaggctctcagtaaatattctctcagtaaatattcttttttttttttttttgagacagagtcttgctctgttgcccaggctgaagtacagtggcatgatcttcgctcactgcaacctccacctcctgggttcaagcgattctcctgccttagcctcccgagtagctgagactacaggcgcccaccactatgcccagctaattttttgtatttttagtagagacggggtttcaccatgttggccaggctggtctcgaactcctgatctcaggcgatccacctgcctcagcctcccaaagtgctaggattactggcgtgagccaccacgcttggctcagtaaatattctttaaaaaagtgtccagaaactgagtccttttattggacagaggggaaaacaggagtgcagagagggaaagggatttgtctaaggtcacctggagagatggtggcagaaccaggaccagaacaatttctcctggcctgttacgatgtgccctctgcctcctcggagcctccccgcagggctcaggtatgagtggtgcggaagcagcctgcatctcatggcactgtgggccactttctccttcgggaagcacagtctgccctgacttctgtcacatgccgctccctgttttccttctccttacctgcttacattcttttagcctcttttgcttgacccatgaagtggctatgtccttaggctctgtctttctcaaggccctcttattgaatgaccttgctcactccacaccttcagtcattccctctccaggctcggtctctcccaagtgcccatttttctggacatctcttttcaagcctctggatgcctggcaggctccttgtgtgcaagagaaaagccttggtcctgaagcaaaatacctggctccacattcactcagtgaacccgtgggtcaatcctcaccactctctgagcctcgaagtttccttctgagaaaaaggacatcttttcattcaatccccacaggtttgttgggaggttctaggaagactgtggattgacagctgtttgcaaacttaaaacatggctccaaaggagggacagcactctgtgctccatagacagtgcacacaagtccccaagtgggccatcctcttccggcctccccctaccatttgcccagacctcctgtctccagggcaaccctaccagtcccccataccagatactggagcctcgttttgcctcctcctctcccccatccccactttgggatccaccagcaacaacgttggttctgcctactcggtatctctttccactgtcccctcctccccctcctacactccaggtcccattagctctcccccagacagtttcagtggcctcctttctggtgtccctggcttccttctgtttggaaaaagcctctactctcctaggcttcagatgtgacagttgcctctaaatccaagatttggattagtggggtcaacaagatgggctgcttgagtggggtcaccagaggatgcacgggttgatggttgaccagacgttcactggtgaggcctgtttatgagatgctttgagtgggatccactagatgctgaagcaggcaggatttggttgtccctctacttgggtgaaggtgtcagatacccaggtgaggtcaggcccagagctgacttgagggagctgaggccagaaaggggctaagacgcatctgtccacatccctccatttctccctctccacccaagggtccttgaattcccagccacagccccctccctcaccccactttgtatgggtctctggggcaattccagaaagtcgtcttctgcccacttcagcataacctgggactttatcccggctccaccacttactcccttggaaaaatgcatttacttacttgggcttcagtttcctctctgaaaaacggggcttttaaatcctcctagctgaggtattgggagaatcagttgaaagtccctccgaagactttggtgctatgcgcaggaaatacatgggccaggggtcactttctctctatccttccacccctcccacttgccccacactctgagcatttgaagggagaagaccttgtcttgttcctgagacactcctcctaccccatgcctggcccaggggtgcccagaaatgttttctgaattgaatcaacgaagggagagggtgttgggaaacaagcagggccctggccaggacatttagacctggggtagggacaggactgtccctcacagtcccaaacacaccttttcatcctgtcaatgaattttggctttcaagtcctacagacctgggttcgaatcctggcccagctccgaggcctggcacaaacgatctcaagtctgcaagcctcagctcctcgtctgcaaaggctgtggagcgatctccagctcacaggggtgctgacacacagtaggtgctcaggaaatggcacccagcccatattcctccttcccttcctccttttcgcctttcctttcttccatgtgagagatgtctccaaggaaacaggaggaattatttaaagaaaagagccgaggactcgggtgggagcggatggtggctcgggcatctggaaggcagaggcaggctgcactggcccttcaaggagacaatgggacccaggtgcctcctcatctcagacagcactaggcagggcctatggcaaatctatgttgaggggcagtggaaaaatgctcctggcaccaaagagcaggaacagagcaatggaccctgctctgcatttgccttacttggtggccctgaaaaagtcccagccctccagccttgtggcctgggggtgaatgggaggtactactgcaagggaggtgggcagggagaaggtgaattggggctggtgagttccgggcttagaagagtaaaagtgaaggtctcagggtgctcctgagctgggcagaaattcattcattcattcattcattcattcattcattcactcatttattcattcgttcaactcatatctactgaactgaacaccttcctcctctctgccaggcaatgagcacacctcatttcacgttttcctcagaatatccttgttatgagatttttgcccccactgtgcagatgaagaaactgaggctctgagaggcgaaatgaatcacccaagtccacaaagtcaaagattcaagcagggcacggtagcgtgcacctgtaatcccagctactggggaggctgaggtgggaggatcacttgagcccaggagtttgaggctgcattgagccatgatcatgccactgcactccagcctgggctgcagagccagaccccatctccaaaaaaaaaaaaatcaacagttctttcccagccttgtcctcattttctatagatcactatcaccttcaataaaaagtcctgatgccttgagaggacctcacggtcatgatgatccagcccctgccaacctttctggcttcacctttgagctctccaggcttccgtctcagtgagctgccagtagtggctcagatgtgccccagcctggcctccaggtctctgagcatgtccttacgctgcaacgtcccctctgtcttccccttgctcttcaggctaagtcctgcacagcttaggggtcacctcttcctgtaacccttctgaccctctcccaaggctcagtcagtgccctccaggagtggtgggttttcttgtgtctcctccgtgggcagcaagccccttgaggccagtgacattcctcatgcaactctgcatccctggtacccaggaggggctggacctgggtgggtatcagtgggcaccaagtgagtgaatgaatggatgagataaggtacagtgtgaaattgctactcctagcctcaatcattttgttctctaaacatttcccaggcacctcctccatgccaggcctgatgccagccccggggaagacgataactcagccttgcaattcactttgtggttcacaacgtgcttccattataacagtcccagccaccctgcaaagtagatgtttgtgttgttttgggctgtgtccattttttgaatgtggaaactgagacccagtgaggttgggtaacttgcccagtcacagccagtgtgtgacagagccaagatatgaatccaggcctgttcactccagagcccacactcccccacaccgggaaaacaaatcaaaatagagcaaaggaatacatgacacttagaaatttattttggaacaaatttggacaatatagaaaatttggaaaatataggagaggagaaaaaaggaggtaattctgcatagctcccctcccctgggatacatgtcattaagtgtcattaaaagtttgagaatcttctgcttgttttggctgagcctggccaagttcatatgatgcaagcagcacacggtatgaacccagactgtcaaatgctgcctttttaaatttttttgaggcagggtctccctcagtcacccaggctagagtgcagtggtacaaacacggctcactgcagccttgacctcctaggctcaagtgattctcccacctcagcctcccaagtagctgggactacaggcatgctccaccacacccagctaactttttaattttgtagggatggggtctcgccatgttgcccaggctggccctggactcctggcctcaagcagtcctcctgcctcagcctcccaaaacactgggattacaggtataactgtgcaggtctcaaataccatgctttgatattaatttaatgtggcctgaaccccaaggagctacttccagtcttgtgggagaggaggaagtaacaggtgtgcctaagcgggggttccccctaagtggaccctgaaacaggcacttgagtgcaggtagtttatctgagaggtgatcctagtctgcaggagggaggcagaggaggagggaaagtcagtcagatgggcatttgccagcagggcaccactgtgggccactggagctccatcttgctggggacgttctgaagaacagtggaaagcgtgcctgagactgtctccctgaaggctcggaggctgcagcatttcctctgtgactcttttccccaagggactgaaggttctgctgggggccttactctcctgcatttccaagccgtcctgtgcttggatgggacaagctcttgcaacttcagaaaatgccatcaggcagaaaagtggagagacctggtgggtgcttgcagcagaccagagttcaggagctgtccaccaaggctgcagcagaattcaagatgggcaccaacagcatttgctttgagacgtggtgtgtctttgtcatcataaagtgttttgggggtataaaaccaggaatgagacatagaatgagacatagaagtcaggggtgatttccccagaataggtgacattcgagttgaattttgaaaggtgactacacaatgggagaagaggcatttcaggtaaaggctgaggtgtgaaacagcttgttgtcttcaggagaaactgcagagcttgtacctgagtcatggggtttggccaagactggtttggtacaagctcaatgtcatcattagctagatatggtcattatccggatttaatcattatcaaattacagacctggtttatattccactttcactgcatctctgtggacctctccatctctttttctgtctttgtctctatgagtttctctctctctttttaaaaatacatacttcagatacacacaagtgagttaaactgagtccttggttcatgacatgccttcagcattggtgcatcaagtcctacagtgtatataatacaagatagtagaaagcataatctaacatatgcaccttgagccactgctcaccccaagaactagaacagaatcagtatctgacatctgcctctgtgctgcaccccatcccatcccccagctctctgctggaggtcactaagattctgaattttgagtttatcctcccctagtttccttgtttttagtgttattacatgcatgcatacctaattaatatgtagtttgtttttacttgtttattaattttatgttaaaaagtgccatactgtatatagtcttgtcttttctttttagctcaatgctgttgatgagcatgtggccatgttgctgtatgtaatcatgatttatttgttctgaaggctgtatgtgactataccattatttatttctttttttattctcccgtcgatggacagtcaggctgtcttctggtcttctgctattgcaaacagtgctgtgtggctgttcctgcgcgtaaatcctaaagctctgcaaaatgcagtctgggcatcctcagcccgggcatcacctggaaacttgttagaaatgcagagtctggggccctgccctagccccgccagaactgaatctgcattttaacaagacccctgggggattcactggcttattcacgtttgagaagcactggccgagtgtacctctgcatgggtttctcttgggcatacacatcaggagtggaagtgctgggtcgcagtgggtggcccagatcaccctctcggccgcagcttcggagctgccactgagctagagcttccccagctcttggtattgtcccacgttctcattgttgccagtcgactgggcgtgcagtggcatctcatcatggtcttgacttacatttcccccatgactaacgaggtcaggcacctcctcgtatgtttactggccatatgtttccccttctgtgaaacgcctgttcctgttttttgctcttttttcttttaggctcactctactcaatcctgcctttgcatatactgttctttccatcagaaatgccttcccctttcgctaccctgtgtcagttcttccaggaagccctctctgattgctgcttaggttgtgagcctcctcagcctcacaggcaggaaaactcggtgtcattgtcccttcattcttctcctgaagtctcttcctcactggagagactgtgaacctatatggcttggtttgcatagagttaacaattttttcactctagttgccattattttcagggattttctgaagttttacatttcagaaaatcttaactgctagcttctcttgaaaaaataagatatggctccactgtctccttccctagatggcaaaatcagctagtgctgagtaggggctgcccctgctggaccatgtgtcacagtccccacaactccaggctcacaacttgcttaaacaacctgtccaagccctgtgggcatttgggtttgtgacccttgcctaagcgtgcccaatgcttgttcctctaaaacttgcccttccttcccctcctccccataaccccatccttgttcccactcagggctttgcatctctcccctgtgccatcacactagcctccttgacattcctttctctagtcttgcctgttccagtccactgccatgtcacactcctgctcaagaaccagcaatggcacccccttgccttcccaggcaccacctgactttctacaaaacaaaaaagtattacaataggaatattttatgtccacaaaaaagtctagagaacaacatgacaaacacccatgtgctcaccaccccggcttaagacataaaccacttcaagtatatttaaagcccttactacaacattcccttccctctctccctcacggtcactactctcttgaatttgctgtctatcactcccatgcatgcttttacacttgtattacatatgtatgtgtcgctaaacaatatatggtattgtgttgtgtgttttcaaactttatgtatctggcatgaaattatgttttccatctgcaacttgctttttccatccaacaatatatatttttattttaaaaattgtattgaagtatagcattcatacaaagagcacacaaattgtaagtgtacaaccctggattttcacaaactgaatcaacagtgtgtttttgagattcagcctcacaatgcataagcttgcaatcacctattttgaggattgtggatcacagacagttttccattgtctgaatgtgttgctatttatccagtttccaaatgatggacatttaggctgtgtccagcttttcactattacaaacgatgctgctatgagcatccttgtgcaagcctcccgggcccccatgtgaggtgttctcgagggcaaagcctgctcatcttcaacctgatcatatatataccgccaggtcgctgtccagcccctggctctcgctggctcccagctcattcgccaagatcttcccactgctccagggagcccactctcctccttgctgacaccctgcccaaacatgccacctctttgcctgctgcatgcaggtgttaaactcacctttccatccaggctttactgaagccctgcctcttccaggaagccctcttgggcagcgctgggcctcagggtgtcatctcctctgagtgacctcctctcaccccagttgttagagccagagaagatagagacaaacccagaccagacactggggaaaggggaatgtgttctggagaaaggaaatatgggtagactagtagggagtgtgagaagctggggtacgaaacagattgctctgggccttgatggatgagtaggagtttgtcaggtagagaggtgggagggcatggcaggcacagggaaaggcagaggctgggcactgaaacagtcatcactgggttggggatgtgagcagggtgggtgggtggtggaggagactggaacagggctgtgaggagccttgcaggccaccctttcacgccattctgacccttctgcattcagaggcattctctggagatggctgtgtgtgggagccagagaaggcaggcacattcatttgacacctactgaatgccaggcaccggtaaagagctcatacccatgatctctttggtttctcacccaagttggggatagagactcgtggtgtccccattttacaggtggaggaatggggctcagagagggacagtcttttgtctgtaaccacagagccaggagaggcagggctggtacgcagttcaggttcatcccactccagagactgcatttaacccccgttcagccagaggctagaagacacctgggagagggttctgcggaagcaggtcaccgggagggggcacccattcctagaggcaggagccccaagttctcgggggtggggtggttcctgactggcgcggtgtgacccgggccagtctcgttctctctgggcctcagtttccctcctccacggggcggcgatggtcaacacaggttcctgccggcccgccccgtagcctggggttccaggctcccgtgccaccgcggcccgcgctgtgtgaccttgttccagtagcctgccctctctggactggcggccccggatttccaagcgctcttccggatcgcgacagagcggtcgcccgctgcggagaccctcccccttcccccgggttgcgggggcgtgggtgggggtggggcgccaggaacggcgcgggcccccccaaggcccccccagccccgcgcccgcggcccgatccgcgcctggttttgggcgcagccgcacggccccctcccccgcgctcctctcccctctccccgccccctccccgccgctctcggggagccggggccgcacggctcctcctcccgcagccgcatctggggcgccgcgccggccggaggagaggcatggggcgcccgcgggccggagccggggcgggggccggggcctaggcgcgcggacctgcgagcggacccgagaggcggcggcggcgcagcggaacggcagagcgggccggaggcggccgaggcgcccggcgcaggtgagggcgcgggggtggcgcgcggcggctcctacccccttcccgggccggcgcgctccgtccctcggctagaccccccgatctggtctcctccccgacagacctccctgaaccgggggacggcgctggcgcagaaaagccccctcccctgccagttctgtcttccgatcccgggtccgaggggccggctgtgcggctgggaagcgccttctccggttgggatcgccccatccatgtctccccggaccctcaaatcgggggcggcggcaccggggcccggaacccctgtccgggaccggatccccattccggctctttttcccgcggactcccccgtaccccatatcaagcggctgccaaagcctggaagccccctcctcaggcccgccccctaatccgcagggcggcctgggggtcaggcggacccctcccgtgcccggccaaccttggcgcttgggagagcagggctatgccggcccgggcattcctccattcaacccagctgcctcggatcccgtctcggtagacccgggagccgccggctccccccttcccgagctctttccctgacctggcatctggggagggggcgggggcagcacccccctcccgcgctgcatagcgccccctccctgtttgcgtccctgggaggggctgggctgacccgggcacctgggctgggggggcactcacatggctaccggaggcccccacgtgcggcgccccgcggagacaggggttcgcgttcagagctggtggcggatggaccaggtggccgcggggaccagctgggtccagatgtgctgggcctgctggaaggggacaggtgctacctggacgtgtaatggcccttggtctcttttggccgaacctgccgctccgatccccctccatcccttcatccctccatccctccatccctccatccctccggcccttctccccttcttcctccgctgcctgtgttgcagagaggggctgtcagagactgttgatgtgggaaaaaatgaaatgggggaggggttgtgattggcaaaggccagttgtgccgggagcggtgggtagaggaggtgccctgagaatgggaagccctaagcttggagggcagcgctgatggggagagggttcctggcacccccacctgcctggaagtggaaatgacatagcgggagggggctgcagttccagcccccgggggactggcctgccctgcctctacctccactgcacctcctctccaagcctagtccccagtagggaggggggagtcctggctctctctgcctctgagccctcacttgtgggagggggctgttttccgccagctggaagtggtgggaatcagttgtacaggaccatctcctagaatgcctgttggaagagccctgtttctgtccctccttggtggccacctctctcttgccttctctgccagagggcactgggctgcctggtcccagggtggggctgcagagctggtgccctggcctggccgatgggtggctggagtgttggagccaccaccaggccctagagccggctgtcggggccagtcagcagcagactccgagtgtgttcccagcagctccggagacgctggctgtgcacgtggggctggctagagtgcctgtctcccgctgtggcaggggtaggccagggatcctgtgtcctccaggagctgggacagcgcaactcaacttctgggagtgtgcccgtgtgtggtgtccatggcgaccccgtactcacctgccagaggcctggtgaggcctgtgctgggcgctggggagtgcaatggctgacagggtccccacctccaggagcctcttttttgttgggggaggcagcctgtgtcaggcattggagacagtgtccatgctgaagagaaactgtgagctggacgggacctgatggctgggttatgtggaaccccgggtgccagccttgagatggaactgcaggtctgagggctgtgccccgggcgtgaagctgcctggcagctgagttggtgtttttgaaggaaggctgtgcagcacttgggaactaggagagaatgtgtgctttggagctttcgggagacgctgacgtatcggatgtatcggggcacccactgacatctcattaggttcttgtgtggtttgtgagccacaggcttcgtaaatgccagcagtttcacatgatggggaggctctgaggaactgtatcccgggcaccgtatgtgacagaagcaggtggtccctaccctcctatacttccgtgatgggtattcattcattcagaaaagcattagaaaatcgcatttgctaacatcagtgcatttgaacactttcatttaaacattctgaaatgtgaattaataaaatcttgaatgcagggtttttttttatagaaagtacacagtaggtactcaataaatgtcatggctcccaggatgaaacccaacctccccctcccccaactagctactttctagccacctcttgctccccaccccctccctctttggctcgggtccccctggcgggccttcagttcctggaacaggccacgttccctccagcttcagggtcttcacacatgctggctcctctgcctgaacatccccagcccccttctcccacgtgcctgtttcactactgctcatcacccaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttaaccactgcaccctcctgccttgggtgagacagacgagggcagggaggctctggctgggtggggtcttcatgcctgtctggaaatgaggtgttcatagcagtgattgttgatgactagctgttctaatgagcaggttttttctgattttgtttttcattacaagagcaaaactgaaggcaggcgcggtggctcacgcctgtaatcttagcactttgggaggccaaggcgggaggatcatgaggtcaagagatggagaccatcctgaccaacgaggtgaaaccctgtctctactaaaaatacaaaaattagctggcatggtggtgcacgcctgtagtcctggctactcaggaggctgaggcaggagaatcgcttgaacctgggaggtggaggttgcagcaagttgagattgtgccactgcactccagcctggcaacagagcgagactccatctcaaaaaaagaaaaaaaaaaaaagaaaaactgattggaaaggtgggcatctgtctcaggcccggagggagggagctgctgattttgaggggtggcccaagtttgagtccccactctgctcactggctatgtgattttgagcaggtcacagaaacctctctcagcctcagtttcccccgctgtcctcagagggataacagtgtcattgcctgtctcagaggcttggtttgagggtgaattgaggtcctgtgtgttcaaggactgaggacagagcctggcatacagcaagtccccaaaataaggcagctggtgttactgtgctctctcctgacacccgcacaccccccggaaccttctggcactccctccctagcctagcccagggcagctcacagaagggccagcctgggaaagtgggccaagggtgagcactatgggcagagccctgcacagagggcacagtgcttgtccccatctcacagaggtgggaaaccggggccacagatgactggtccaaaggcctcaggggtggagcggggactggatcacagcctcgtgactcacagtccagtgcctttcttgctgcccaactccttagggattcttgggagaacttcaaggagctaaagagaattctaggggcccccagggcacctaggaggcctgggaggcaggtgcttgggccctcctcccctcaccaccccaggcctctgtgtgaccctgttggagttgcctccttctctgtgcctctgtcacagcaaggtagcggggagagtctggaatctgaagaacttggattcaaggccccctcccccgggcctccctctgcgtcccactcccccgggcctccctctgtgtccctctcctccaggcctccctctgtgtccccctctcccaggcctccctctgtgtccctctcctccaggcctccctctgtgtccgcctcctccaggcctccctctgtgtcgcattcccctaggcccccctctgtgtcttcctctcccaggcccccctctgtgtctttctctcccaggcccccctctgtgcccctctcccccgggcctccctctgtgtccccctcctccaggcccccctctgtgtctccctctcccaggcctccctttatcccctcctctaagccctcctctgtgtcccccttccccagccccaccccgtgtcccctccctcctctgctgtcctggtttgtgcctggccgacattcaaggtggcagctttggggtgggagctcaggcaatgggaaccatgcttggaggggcccagccaggcccacactgacccttgccctggtggactccctctgccagggcaggtggcagtggggctgtggggctgtgagtgggggctctggttctccccacgctgcaggcctgcgtcatgccccccactcccttgctgcatgccctgcattggaaagcagatatatttagacgaaatgctgtgttccagacagattctgcatccactgtacttgtcagggctgggggaggcagggcctgtgagcagccacacctggtacctggagtctgggcccccctgagccctttgcccacctgcctgggacctctgggggctgctgactgggtgagggggacactgatgagacagaggcctggccctctaccgactttggacgggtctccctctgcaccctctctgccgcctaaggccacatctctctaactctttacctccaagtcacagccaaatcagtccttggctccctgtctgcccccagcttcctctgaatccccgaaccctcctgtaccccttccaggactcagcactttgtcccctgtgtagtcagtcagcaaacgaggatttgagcctgctgcgggccaggtccttgctggatgtaggacctggagatgaaggccctcaaaggagccacatcacagtctaggagcgggatcatagaccacaaagacaacagcaggtacccgcatggcagcaggaagccctagggcaagggcacccatgctggggtgatggtcagggaaggcttctcggaggagggagtggtccaagctgacacccgttggttaagtgagagtgagcccacacctggagacgaaacaggcattcctggcagagggaacagcacgtgcaaagggctggggttgagggaagacctggctgcacatgggagaatagggagcaagaagacgggcagggatggggtctttcagagcctcaagtgccaggctgagggcctcggctgccccatgggccctggagggctgcgggggagtttccagcaaggcagtggccaggtctgatgtgagcatagctggggcagctggtcattggttccacagccactcgccaggctggccccggcttccacctcggatgtgctctgcccagcctggtgggaatcagaaatagctcacacgtgctcagcgcctggtgaggcgctcgcccgcctcagcgcgtttcatctgcgcccgagtctaggagggctcagtgcttgtgagctgggtgaccttctcactcctacttattaatatgccacccactggggctgtaggcagagttgggagaacgagcatggggagggagcgaggagggggaaaggtgggggtcccagggtgggaaatgctgagggcttggaaatggtacctgcccaccagaacaatatgcagcagataaaacccaaagtatagagacaaatatacagatccccctcgatctacctgcagtggtgaccacattttgatgccgaccttccagaggtttctccaagtctgtctgctgtggcagatagattcattcattcattcaacaaatatttgttgagtgcccacttgatgccagaccctgtggtgggcagaggggacatggctctgagtgaaagggactctcctggcccttagggaactcaaaaagcaggtaaaacagtgatgaggcccacggaggagggtcacaggaacatgggccctgactggagtcacaaaggcttcctggaggaggtgacacttgaactgagacctaagggatgaggagaagttgccccagcaaagaggagcagaagaaaacattccagcagagggaactgcaaatgtgcaaaccccggggtgtgaggaaggtggggttttcagggaagaggaaggaagatggtgaggctggagtgttgggatgtggagggaggacaggtgaagcactagaggatggcgggggccagacggtatggggccttctgcactgtggtcagggtttggggatttacataagagcgtgggttgtggcgccagaaggtctagatgcaaatccagctctgctgcttattaggggcttgacttcagcaagttacctaacttctctgtgcctcagtcccctcatctgtaaagtaggggcagtgatggtccctgcctcataagactgttgtgaggatgaagtgaggtaataaagtgcgtaggacagcacgtggcacacagcaagtgcttataaatggtagctcatataatgtcacagtcatctgtagatggagggcatctgtgcagatgactttgcaatagggtcacattagtcctgctcatctgcagctacttcttcccttgatgctggccatcctcctgagtcagtgactaccgagtattattctatttgaaatttctgagttgtagtatagcacgtgttgtagagtgtactaatcttaagcagatagtatagcttgatatatgtgtatatctcacccttgtaactaccactaaggtcaagatgcaggatatttccaggccaggtgcagtggctcacgcctgtaatcccaacactttgggaggttgaggagggtggattgcttgagcccaggagttcgagaccagcctgggcaacatggtgaaaccccatctctacaaaagatacaaacactagctgggcatggtggtgtgtgcctgtggtcccagctactcaggaggaggctgaggtgggaggatcgcttgagcctgggaggttgaggctgcagtgagccatgttctcaccactgcactcagcctggagtgacacagagaccctatctcaaaaaaaaaaaaaaaaaaaaaaaaaaaagatataggatatctccagctataccaaaaggctctgtcttgccttttccaattaattccccacctcccttccccaggggcaaccaatattctgactcctaaagccatagctttgttttgtctttttcacaccttcacataaacaacatcatgcagattgtctcttttgtgctaacttcttttgctcctcactttgtcaatgagattcatcatggctgttgtgtgtattggtaagttttcttttatattgctgcctagtattccacttagcgaatatgtcatacgttatccattctattgttgatagacttttggaatatttctagtttttgactatatggatagtgctgctttgagctttctcatagaagtcttttgggaaacttttgcggttatttctgttggttatataccgagtggagtttatttattctgtgggttgtctcttcacttttttgatagtgccttacagcagggatccccaacctttttggcaccagggactggtttcatggaagacaagttttgggatgaaactgtttcacctcagatcatcaggcattagttagattcccataaggggcatgtaacctagatcccccgcatgcgtagttcacagtaggattcgtactcctgtgagaatctaatgccaccgctgatctgacaggaggaggagctcaggcggtaaagctggcttgcctgctgctcacctcctgctctgcagcccagttcctaacaggccacagactggtacaggtccatggcccaggaattggggacccatgctttatagcacaaaagttttaaactttgatgaagtccaattcatctattttttttctttgggtgtattttcttttggtgtcatatctaagaaacagttgcctaattcaagggcatgaatatttatgcctgtgttttcttctaagagctttatagttcagctgggcacggtggctcatacctgtgatcccagtactttgggaggctgagatgggaggatcatttgaggtcaggagtttgaaaccagcctggccaacatggtaaaacctcacctctactaaaaatacaaaaattagctgggtgtggtggcgggcacctgtagtcccagctactagggaggcagaggcaggagaatcacttgaacccgggaggcagaggtttcagtgagccgagattgcaccactgtactccagcctggggaacagagtgagactctgtcaaaagaaaaacaaaaagagctctatagttctagctcttacatttaggtctttgatccattttgagttatttttttgtgcctggtgtgaggtaggggtcaaatttaattattttgcatgtgaacaataagttgtgctggcaccatttgttgaaaggactgttctttctccattgaatggtcttggcacccctttcgaaaatcaattaaccataaatgtgagatttgttgttgtagttgtttgtagatcctcagttctgttccattgatctatccttatgacagttccacattgacttgattattgtagctttgtaataagtttcgaaacttattatcttttaatatctgtagactctgtagtgatgtgacctgtttcattcctgatatttgtaatatgtgtctgatctttctttctcatttttaatttttgatcagactgggtacatatttttcaatggtattgatctttttgaaggacagcttttggtgtcactgattttttcttattgtttgttttctcttttattgatttgctgttctgatgctattttctttctcccacttagttcagggttaatttgtttttctttttctagttttgttttttttaaggtaaaagcagaggtcattaatcttaaagcttttgtcttcatgaatataggcatttagtgctataaagtttcctctaagtactgctttagcagcaccccacacattttgatatattatattttcatttttattcagttcatagtactttctagtttcccttttgcttccctctttgacccatgggttttttagaaatgtgttatctaatttccaaatatttgaggatttttcagggatctttctgttaattgtttttagtttaattccactgagattatataacatattttgcataactttaatcttctaaaatgtattgagacttgtttaatggcccagaatctggtccatcttggtaaatgttccatgaaaagagtatgtattctgttgttaggggatggagtgttctataaatgtcgggtcaagttggttgataattttcaaatcttctgtatccttatttattttctgttcacttgctctaccaattattgagagagagctatagacatctctgactataattggagatttgcctatttctccttacattcctatcactttttgctttatgtattttaaagctttgttattcaatacatacatatttaggatcatcattcctgttgttgcattgacctgtttatcattatgaagtgattttataatattacaaaatatactttttttttttttttgagactgagtctcgctctgttgcctgggctggagtacaatggcacgatctcggctcactgcaaacctctacctcccgggttcaagcgattctcttgactcagcctcctgagtagctgggattataggcacgcaccaccatgcctggctgatttttgtatttttagtagagacagggtttcactatgttgaccagactggtcttgaactcctgacctcaggtgatcctcccagctcggcctcccaaagtgctgggattacaggcatgagtcactgtgcctgtcctgaaacagactttttctgatgttaatgtagccctcaagattttaaaattggtgttaacatggtctatattttttcatccttttactttgtacctgttcgtgtttttatatctgaagagcatttcttgtaggcagcatatgtcaacataccaaaatttgcaggatgctgttaaagcggtactcaggggaaacccaataagttgggccccagattcaccccaggtttaaatcttttctcttgctatttgttttctatttgccctatctattctttgtttctcttttcttatttttctgctacctttagaattaatcacatttttgttattccactgtatctcttgttaattatagccataactgttttattttagtgcttgcagtatggcttacaatctacactttaaacttattgcagtgtactttcaagtgatattatatcagttcatgtatagtacatcacaatagcatacttccatctcttcgatcttgtagtattattattatgtatttgacttttatatgtgtaataagcacaacactacattgttattgtttttgtcttgatggtcattatcttttagagatatttaaataataagaaaaataatcctatatatttacccatgtagttattattttcagtgctcttcattcctttttatagattcatatttctctctggtatcattttccttcagcctgaaggattttaacattccttatagtgtgagtatgctggtgaggaattctttcagctttaatgtgtctgaaaaagtctttattttgccttcatttttttaagttatttttgctgggcatggaattataagttaacagatttttttttctgtattttaaagttgttccactgtcttctcacttgcattgtttttgacaagaaatatgctgtaatgtgtatccttgttaccagtatgtaacacatatctttcttttctggctacttttaagattttctctttttttttttttttttttttttgagacagtctcactgtgtcacccaggctggagtgcagtagtgtgatctcagctcactgcagcctccgctacccaggttcaagtgattctcctacctcagcctcccgagtagctgggactacaagtgtgcaccattacacctggctagtgtttgtatttttagtagagatggggttttgccatgttggccgggctggtcttgaactcctgacctcaagtgattcacccacctcggcctcccaaagtgctgggattacaggcatgagccaccatgcctgacctaagatttactctttaccactggttttgaatgctttggttatgatttacctccataaggttttcttcatattttttgtccttgggttcatttagttcctgaaatgtgaagatttataatttataattttacacctggcagagtgcagcacaggaaacgagaggaagtgtcagagcccacagcttggtgaaggccactcttgactcagtttctctatccatctgctaggccgagggatacctgcattccaggacattcctttgttccagataagaattatctggttaaattctttttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcaagaattatctggttaaattctaaggttgccaggcacagtggctcacgcctgtaatcccagcactttgggaggccaaggcaggtggattgtttgaggtcagaggttcgagaccagcctggccaacgtggtgaaactccgtctctactaaaaatacaaaaattagctgggtgtggtggtacacgcctgtaatcccagctactcaggaggctgaggcaggagaattgcttgaacctgggaggtggaggttgcagtgagctgagatggtaccactgcattccagcccggacaacagagcaagactctgtctcaagaaaataaaaaaaataaaaaataaaaattctaaatttaaagtgcacattggcaaagtggccagtgtgtcaggtggttgggtgtgccccttaatttgatcactcagcttctcctgggcatcttttgtgctgagtagggcgtccagctgggaggacatcagaccctgacaagttgggccccagagtcaccctagaagctaaaaatacacaatgagattaaagaaatgccattataaacagcaatggttcatcttatttgtatacaaaactggcaggtttttttttttttttaaataaagtccagcatagacaagaatgcagggaaattgatcttcccagactctatcaggaggggtataaatcagaatcccctgcttttgtagggcaggttggtacaggattgtcacaaagtttggggggttttattgtttgtttttttgtttttttgagacggaattttgctcttatcgcccaggctggagtgcagtggtgcgatttcgtctcactgcaacctccacctcctgggttcaagtgattctcctgcctcagcctcaggcatgagccagcacacccagctaattttttttttttttcttaagacggagtctctctctattatccagatggaatacagtggcgcgatcttggctcactgcaacctccacctcctgggttcaagcaattcttctgcctcagcctcctgagtagctgcgactacaggcatgcgccaccatacccagctaatttatatatttttagtagagatggggtgtcaccatattggccaggctggtcttgaactcctgaccttgtgatctgcctgacttggtctcccaaagtgctgggattacaggtgtgagccatcgcgcccggcctaatttttgtatttttagcagagacggggcttcaccatgttgggcaggccggtcttgaacgcctgacctcaggtgacccacccacctcagtctcccaaattcctgggattacatgcgtgagtcaccatacctggccaaggttggaattttatctatgtttggcctggcaatttcagctccaggaaattttaagaaaacagttcagattgttggagccaaacagtcatgagtttgaacctggatgtaccacaggtcaccagttatgtgacctgggactagttactctacctttctgaagtttcatttgcttatctgtaaaattgggattttaatacttatatcatctggttgtagtgaggttaactgaagtaatgtgtgcaagatattcagcttagggccagacacagcgcaaaccttgtgcccctgggggatgtcttgatgacgtggatggaaaaaactgagtcagaagtggcctccaccaagcttttggtcctgacacttcctctctatccctgattatgtataggaaataaaaaggctgagccggacacagtggctcatgcctgtaatcccagcactttgggaggccgaggtgtggggatcacttgaggtcaggagttcgagaccagcctggccaacatggtgaaaccccatctctactaaaaatacaaaaattaggccaggtgcgatggctcacgcctgtaatcccagcactttggtaggccaagtcaggcggatcacaaggttaggagttcaagaccagcctggccaacatggtgaaaccccatctctactgaaaatacaaaaattagccaggcatggtggcagatgcctgtaatctcagctacctgggaggccaaagcagaggaatcacttaaccggggaggtggaggttgcagtgagcaaagatctcacactccagcctgggtgacagagcaagactcttgtctcaaaaaaaaaaaaaaaagactgaaagacacacaccataatatcagaagcagtcatctctgggagaataattttattttcctaatgccgttctgttttcttccagttttctacagtgaacatatattgcttttgtaacaagaaaaaaatgacaattaaaacacagtgtgtctcgttcttccagagcctgcctttgaaggagtgaggagcctgatgggccaggccagaggagggttttgtgggggaggttctgaccatattggtgggggctccaactatcgtggtgggggcggcaggactggagaagggctaggttactgcccctctatgccccaggctagagccaaggttggactctgagtggagattatggagggaggtggtggactatatggcttctagaggtggacctatttactctccgtgggacctcagctcagtgccttcagttctctgtgccttagtttcctcatctgtaaaatgtgcctctatgggacctacttcatagggtagctgaggcttcagtgacttttgggattttttttttttttttttgagatggaggaaagtcaactcctttcccctctgtcacccaggctggagtgcagtggtgtgatctcggctcactgcaacctatgcctcccggattcaagcaattctcctgcctcagcctcccgagtagctgggactataggcgcccgccaccacacccggctacttttttgtatttttagcagagacgaggtttcaccgtgttagtcaagatggtctcgatctcttgaccttgtgattctgcccacctcagcctcccaaagtgctgggattacaggcgtgagccgccacgcccggccgacttttgagtttttattttgagtttttatcacagtgccttgtggaccgtaaatgttagctattgtcactgttgttgttgttattattattattactattatgagtatcatcatccaccattcccttgcttccaattcaagtggtgaggagagagggctgggctgtccctcacaaagtgggccatgtgagagagacagctcatcccccctgggggcctgtggggggaggccaccccatttccctgggccttggcttcctctctcacctgtggggatggctacttccacgtggtgagaaataaatgggtcctcctgtccagtgcccacactccaaagatgcctattgagcgtctgctcccagcccttcagggaggacccatgctgtcagaaaacgaggggaagagtgtgagaggccaggtgggagggccaacttggggtcaggtgcccagccaccgggaggcccatctccggcatccccagctgcccctcctccagctcaccgatggccttggagggagcaggaccaacatgggaacattaatccacctcattacctccctttgctgtggagttgtagcaattagacctgcagtctgggcagcattaggagccaggcaggggtcacccgggctgctggccccctgccgacccagcctcagcctggactcactctgtctctggggagaggggccagagaagggagttccctggcagcagaatctccctcatcactaaagatggatgcagagatggaagctttggcctcttttcacttacccactcacaggtgtttaacagatgtttatggagcacctactgtgtgccctggagacagatgtggtccctgccctcacagagctctcaacaaaagtaaaataattgctgctagtataaatgctgtgatggagagcagcagggtgacaggtgtctgctggggtggtcagggagggcctctctggggaggtgacatttgagctgagacctgaacacttacaaaggagccagtcttttgaggatctgggatcgggtgggggttccaggcagggaacaaactggggaggttgtgctggcggacatgttcagatgcggctggaaaagagtcgggggcgggtagggggagatgaagtcagagaaataaggacagggggtgcgtctagccataggaaggacatgggttttccctgagtcaagccagagaccttggaaagcttggagctgggaggtgatgtgatcagattcatgggcatgagacttcctctggagaagggatgcccaggagaaggctgggccagtcatctggacgggatggagaggatgaggtctgggtaggggcaggaggctgggctgggcaagggattcagagccttccaatgagtccttcccagcctttgagcctcatcctcttcaccaagaaatggcccgatctccacggcccccctcctttcctctccttttgacacctgcagactttccctgtcccgcccgttccgttttttgttttttttgttttgttttgtttttttgtttctttgtttgagacagggtctcactctgttgctcaggttggagtgcagtggcacgatctctgttcactgcaacctctgcctctggggttcaagcaggtcttctccctcagcctccctagtagctgggactacaggcgcccgccactgcacccagctaatttttgtatttttagtagagacagggttttgccatgttggtcaggctggtctcaaactcctaacctcaagtgatccgcccgcctgtgccatcttgggtgcctcactgtgcatcatctgtcccggcagccccaggaggaggtgcccccatttcacaggtgaggaagtggagactcagaggggaaaggagttgcccaggatcagagctgggcctgcctgggtctctattctctctagcacctcccctcccatcccagccccccaccagtcaaggccccttctgagccatgacctcaattttccaaggtaaggcagcttgttagcatctcaaagaacactctcgcctgccaccatgtatattcatggagcttcaaagaggaagctccagacaggaggctctttctttccttccaagagcaaattctcaccctctcagatgcaggatgtagtctggctggaaaaagacttattttttcttctttctctctctttttttactagctagtaaaagggagatgctacctccggctcttaacgactgaacatttgttctgcctggttggtttgagaagttgtgggggcttcagagaccttggccttgcagtggattccgaggccatctggtcccactttgagggtcacagaggatggggacagggttcagagggcatcagggcagcatactcatcctgctgcaaatgcaccatgaaaatgcagctcttctccttctattggtgtgtgcttgacatttttcatactaagaagttaatagagggtttttttttctaaaacccctgagctccctgagcacctcactccgttccagccactctacctttgcccacgcttcccctctgcctgatgcgcctctgtgtgcctggtggattcccgtgcatgtttcaaggcttgattccaatgtcgcctcctctcagaagcctcccctgactccctgggtggtcatggctgtgctatgcttcctcctttatccagtggatggctttgattccttgtagcagtcctgtgaggaaactgaggcttgcccaaggctgcatagcatgggtgaggattcaaatgtgtgggttgctgtgtgactccccgcgaaccactctgcccttctgccctgcacatcacacggcattctgtaggccaggtcttcctggctgggtctgcccctgctggcctcgaagcccttcaagggtgggtccacatgggtgtggatcttgggtacccagcttcgggctgttactgaggatgcactgacaggtgtttcccaaatgggtgaaaacatagataattttccccactccctgccattatggagctaaggcagaacttgggaaactcatgggacctgcctttagaggcactaggagcaagaaacccaggcaggctggaaagccactgtccccacccagcgacccacaacccacaggggtgaccaggtatctggggagtggcgactctgtggacagcaaggatgtcgtgtgtgctgcgtcattcagcaaacacagattgagctctgtgtgccaggcacagggctgggcaccagaagcacagcggtgaacaagccagacccagcccctggcctcccagggctctcacatgagaggtggagggtgggcagaccagaaattgacaaaaatgctacagtgtggaaaacaacaattagggggttggtctgcagggcctctgggggctgggagagttatcagagacttttcagggggtattactgaggctgagctctgctggctgatggcgagctggtcagggaggtgtctgaccagcatcctgcaaaggccacgaggtgagagaatctaagctcactcagggaacagatgagaaggagtgtgacctgagggccggggaaaggagaaccattgaggtctgaggggcatagcagcggagacagggcttggcttgtggttcgaaaagccccctgtgtgtgcagcagggagtgcaatttgcaggggcccaggtggccatggagaccccacgtaggaggctggtgctgttttcaggggagatgaaggtggcctgaatcgggacaggggctggggaggtcaaggcgaggggccaacccaattttagaggcagagcctgctggattttgtactgggctaggtgaagggcaaggaaggcagtctggctgagccctggaggtgaggaatgctggttactgagattgggagttggggctgctggagacacggcagctaaggctttctttgtgaggatctccacagtggcctaggggcagctgggtcgccggcacagggtggtccctttcccccagtcctgcctctcagcctgtatctgggaccgacgtgtctattggaggtgaaaatcatgcctcccgcctgagcccgattgccccccgggggtggcagaacgccaggtgcccattttaattctccgacagtcatactgctttattgttcctatttgggattttattattattgctgttaatggtttgaaaaggccttttaattaaagctgcaggttggagctggcacctgagcccctggggtgggtgggaagaagccttgccaagcgttcaccccacctcttacagagctggaggcttttgagatgggggctgtgaagccttccatggggagactaggggaccctgccgttgagaccatggtacagccaccgccaggcctcagttctctgcctgtgatacaaccagaagattttcccagcacagatggcatgacattgatttgtaaatggacctgttggtagggagctggtgggacacacctgggtttcagtctcatctttgctgcttactggctgcaggaccttgagcaagatgcttaaatggccgcagcctctgtttgctcatctataaaatgggagtgctgagttcctgcctccatagggctgttaagaggaataaagagatgatccaacccctggcccaggctgaacactcaataaatgggggtcatgttattgtgactgtcgagactgtggggatcaagcgaggctgtgtgtctgagcctagcacgtggtagatgctccggacacagctgctccggacacatcagctgctcttatagcagatgttgctgccttctcctccccttcttcctccctcttgttcccgaacgtgcaggaggtttgacccgtctttgcctttgcacatgctgtttccccatccgtcgtgcctcccttcatcttttgcccacctggacatcctttttgacccaggtgtggagctgccccctctgggaagccttctccagctcctcctttgggacctggtttcccagagctgcccaagcatcccctcttaggggcctggtctccctgcctgtaatgacttgttgactcccaggggttgcaaactcaggggcctgcaggacctggcagatcagatcagagaggaatattgtcgagtgaaggatgacaggttcctgtttctaagcgctgctcccaccctgtggccagggccctcctcccctgcctccagagggacagttccctttagagagtttgccaatccagtccatgcccatggaacacctatagtgtgttgccctgagctgcggggcacctccaccacgaacttcctccatttccatcctcgtaaccacctacgacatctttccatgcccatttggctgacgacgagacaaaggccacagagctgaagtttctggcctccagggtcacctaggagacaactgttgatgccccatcctgatttcctcccctgaccaatattggcagctccatcagaatcatgttcttccctaggacccttgcgcttgctgtttcctctgcctgagactctgcccccagacacctgcagggcttcccgcctgtgttaaatgtcgcctcctcaaagagccctcctctcacccttctccctgctctgttatgcctatggctgtgatcacaccctgacatgttgtacatttgtttgtttaatctgcatctttcccaccggacttcaagtcagcagccctgtgtgtttggcttacatcttatctccattccctaggatgatggctggcatgagtaccagcaggtgtttgtggatgagtgactctcctaactgtgggtgtgtgtgggactaaggggacaatgggggtccagcagtcccaggggcagggaaactgggaaactggagggcccagagggcagcccccatcagctgctccccactcctctggtttccttggctgccttgatgtgcccacccttgactgtggccttgcatccaaccagagtgggcgtcagtccagctttgctcccgcctgctgtggagacagccagcccccttctccttcctggggccactggagcccagcagaccccagaggggcccccagcccgcacccagtctcccatctcagccccctctctgctgtgcgcacacctctccctcctcctacagcaaatacattttggacttaaaataaaaagcagatacggcggaggaaggcggagggagctgggggagtcgggagagagtgggtggggcccagcagcagctgcagccgcatttccccatggtgggtggggatgaccaaactcattctgcgcatcagaaactgggtctcagagaggttaagtgacttgcccaagggacaaggcccagatacagccccagcgtgatctacatacatactggaggtcaggctcacttcagccctgagggcaaagccagaaccaacaggatgttttaggggttactgctcattcgctcaataattcatggaaatgacatgctatgcccagcggcaggctgtggagggggatgggagggaagtggtgggggtggtggagggggcaaggcccgctgggtaggtgcagggaaggcttcaggttggggatgtgaaggatgagtgggcattccaagcagctggggaaggcgggaagggagtccagataaagagggagtcctaagccactcagtgctgagctgagatgggcctgagagggctgggtctgccctgtgctgtgggctctggagggtgggttcaggcacagacaggaggcagggacactggctgctcctcatggggtctcctgactctgggatcctgagggttaaatttgcagcggatgcagttgtcacaataacccctcctctgggaagcgggtgcttcccccccaggatgtttcaagcccagacttccccacccctctgtgtccctctgcagcccatggcattgtgccctttctgcctcttctggtgggagaaggcctaggctggttgttgcctgctacctgtgctgggattggtggtatgcctgtgacccctcctgatggatgtcagcctgctgggcacccacaggcccttgcctccccatccctgcctacctttagcctcaccactatgccaagagggaatggggcttggcctgtgccaggatgaggaagccgaggccccaagaggggaggggagggaggagtgggattggggagtctggaaggcctgggtctgccccagtcctgtggtccacatgtgtgggcaagtagcctgtgcccctgaacctcatggtcctcagctgcccaggaagctgggaaggttgcagggttgggaggggagcttcttaagctgtgtgtgacgccctggacacatggtgtggggagctctgtctgctgagagctgggcactggcagggactcacccacgagtgcaaggggggaggcaggagggcccatctggaggctactggaatggtagtaagaaacaccatgccgggcccattggctcacgcctgtaatcccaacactttgggaggccaaggtgggcagatcacctgaggtcgggagttcaagaccagcctgagcaacatggagaaaccctgtctctactaaaaaaaaacaaaaaatacaaaattggccaggtgtggtggcgcatgcctgtaatcccagctactcgggaggctgatgcaggagaattgcttgaacccgggaggcggaggttgcagtgagctgagatcgtgtcattgcactccagcctgggcaagaagagtgaaactccatctcaaaacaaacaaacaaacaaacaaaaaacagtcattcatttagtcatgtattgagcaccgcctgtgtgcaaggccctgggccgactggcctctgtccttggggagccgtcggtccagtaggggagtcaacaaatgacaacaaaaaaatagataaataaatgaataaatgaatgcaaccgtgccacacagtgaaaggtcccaacgcagtcggggctgggaggtcctccctgggcaagtgccatttgagctaaaccctgaggaaggagtgacagccacccaggtgaagagggagagaagggcattctgggcaaggaaacagcatggcaaaggcaccgaggcaggtggggcagagcaagcatgaaggcctgggaacactggtgagccagggagcaagagccagagggaggaggctgagaggggctggggactcagcggctctctcgggagacattgcagattttatctcaagagcagtagggagccacggagggttttaggcagaaggtaatatgatctggtgtgcattcatttttttgagatggagtcttgctctgttgcccaggctggagtgcagtggtgcgatctcagctcactgcaactctgcctcctgggttcaagccattctcgtgcttcagcctcccaagtagctgggactgaaggtgcgtgccaccatgcctggctaatttttgtatttttagtagagacggggtttcaccatgttggccaggctggtcccgaactcctgacctcaggtgatccacccgcctcagcctcccaaagtgctgggattacaggcgtgagccactgcacctggcctgttttttttgtttgtttaaggcaaggtctctgtctgtagcccaggctggagtgcagtggcacgatctccgctcactgcaacatcaacctcctgggctcaagtgatcctcccacctcagcctcctgagtagccaggactacagccaccacccctggctaatgttttttaaaaaaattttgtagagactgagttttgctccaactcccaccttggcctcccaaaacgctgggactgcaggcctgagccatggcgcccaacccagtgtgtgttttgatgtgcttattctgccccctgagtaagggagttagaggaggccagagtggagcaggggaatgcggggcacaaactcccagtgggccatctgcaggaccagcagtgtggcatttgagggggactgagaaggctgtgtttcctgtggagaggcagagccagtgctggcatttgctcatggaggggacgcacagctccggcagaggcgttaaggtgggaatggcagaggagggaagatcccagagggcctgagctctggacctccggcaagaggtgcatgctggacaggcagtggaggctgggttgggggagtgaggctaaggcagccgcagagcggggaaggagaggagcctggagtagccaggggtgttgattagcatattcatgatcttgccgcccacatgaatatgctaatcaaccctgtggggtttgggggttttttgttttcccctctgtggtagaaggaggcctaagttcccaataccctcacctctgggaacagagccccaagtatgagtgcggtaggaggggccccacatccccaacatcagctcctcccttctcctggctgcccaacagcccctgcacaccctccgtttctcgggaacttctggctgttccggaagtggagatggtgaggaaggggatgtccttgggatgcccatgccgcacccacactgcaggctgggccaaggctgcccggccccatgctgtggttccccgcacgtggctgcttctcgggagagacccgtgcacgggtctccagtgactcaccctctccgtggcacatgtggcagggagtgggtcggctcaggcaggaaacaccaggggcttgccacaatcgccagtctgtccccagtgcccccgacacctatgtgcccccagcccaggtcgggggtctctgctggcctccttgcaccctggtctttgtgaccagggaaatggccacatcagatcagcggcattagttgtgtccccacccctgcccaccctctggcatgagttcctgggcggcagggctgagtgcatgagaagaggcggagacactgctgcccagactaggcctccctctggcatccctccggagaccccaggggtcccccagttcagcctggtccctcggggggctgtcgggagccaaagagcttgatgcaggtgctgcgatccagcgggtggagggggaggcataattagctgtcaccagaggagtgagtcaggcaccactcgtagctttgagtcagccccaaaggggaaggggacacagccaaggtcacatgccagcaagttgggcctggtctccctgagcacctcccacccctccccatgctcctcctggaacaaactgggcctgctccaggcggtagctctgaggagagctgggaggcatttctatcacccattgcacaaagagggaaactgaggccagagagggcacttgcttcctctgtgcaatcctccctgtctgcacagctctctgttcaggtccttaaacctttaccaggctgctccccacctcaggacctcggcccggccatctcttctgcccagaacacttccccagttcttatccatcaagactctccacccgagtgtacttttcagaggagccttctgtgacctttgtcttgacccctggttttctctgtcccaggcccttgggacacttatcatgacttacaattgttttgccagttttgtctcacccccttgccaagagctcagcgtcctcatctgtcttgttgactgccccaaccccagcccctagcaaagtgcctggcatgtaccaacgatggtgatgcctggcactcactgatatgcaccgtgtgccaggcaccatgcaaccacctccgaaagcctttgttcccgcagtaaccctttgagagaggtgcggtttccatccttcctggtttagagatgaagaacgacgtgcagggggccacaggccttgctgaagggcacgcggctcccgcggggaggagttggtgtctgatctcccagatctgcacttgggtggcccactgggctgccaccccctcagtccctctgctctagtgcacacagtaggtgcttggcaaatattgggtgggtgaacagatgggagaacaagcttctcccagagtcacccagacatcgggggaagggcgggcctgtcgtcccagcttccgctctccagcattttcctaatgctgctggggcgccgtccccagcactcagtgggcaccaccacagcctcccgccttcctgcaggctggcagagcaggctcagctccccaggcacacttcattcgactttctcctcatttctttgagcagattgaagagtgggaacagcagcaggctgttggatcggggtgtcggggacaagagggttcatttcccaggaacccctggtggccggagtggagccctgaagtccaggtaggaggctgtgcacatagccccccaccaccctctttctgggctggggtctccccagcgaggggccaaaggtcagaactttagagccaggggcctccatacatttgctgtgtggtcttgggcaagtcactccttctctctgtgcctcagactcctctttggcaaagtggggcacaagatggctcctatctcttcatcccactgcaagaacctggaagccaaggcacggcctccagaagggataacgggagtgcttgttggctgaatggagttgggggctggatagacagggtaggccagtgagtgtgtctgggtaagggcctatcagggaaaggggagtctgtttggggctggaggcctcagcccagtaggttcccagccttgaaggccaggcccagctcccaccaaggccccatgacagcctcggtactaccaatgctgatgaatgcctgggcgccagcagccaccccgctcagtggaatcagctgtgatttatgggattggggcccgcagggagcaactgtctgagctcagagaagcctcagaaaaatgggtcaatgcagggcagggctgggatggaggtaacctctgccaactggaaaggctcagagactggctcctctgccgcatagtcctggtggggaaactgaggcccatggaggggcctttgctggcagagaggccctctagtgggcagcagaaatcaaaagccagaactagtgtccagtactgggaggtaccttatagacttcagggtagccagggaaggcctctcagcagaggcgacatttgtgctaggccctgaggcatgagaaggagccatgctggtaggaggtgagctggtggtgggagcagcaagggcctgagcttggaggtgggacagaggctggcacgttcaggaaagaacaaggagggcagggcacctgagggactgagtgagggggaggggagagggagaggatgctagagaggagcggggactgctcagccctgaggggccttctggccctcagccccagtttgggccttttcctaagtgccctggaaagcctctgaagtgccggcagctcaccggctcacattttacaaagacccctctggcctctgtgaaagtgaattggagcagcatgtggaaggcagggagtctgaggagacggctgcagacatcgtggcaacgaacagctgtggcttggacccagggtggccaagaaagacccaagcctgggagctagaatttgtccctgggattctagtttaagccactcatctcctctgggtagtgaccaattttaatgtctcaaaactgtgatcccttgatgccccacaccagggcccaggaaccgtgtttcacagagtcagtgccacatcataccaactttatgatgtgctcaaggtcacccaacttggaaggagcagagctgggatgggaagctgggtttcttagttccaccgctttttaatgcctcatttgcccctattcccaccggaggtgaaagctgcacctcctcaaggaaaaaaaatggatttttgaggctaccaggtacccccccccaaccccccgttgggtgaatttgaactatatctgtgtctgcacgcatgcatgcacacacttcactcagcaggaaatttgggacaggagcagcttgggtgcatgtctgggccttctccttgctgggaaaccaggccagagctggagaggccccagcagcactgctctggtgccaccctctccccggtactcagatgcctgctggcaagggcactggtgggccccgagtggctgctggcccgtggctacagctgacacacattgtctctgagctacttcatgtttctgcctttgacagagaaccctccagcagagcagtgggatcactactgagggagctgcctgcctgctgttccggccatgggggtgcaggggagtgctgttcaccttgccaggggagcctagcatagaccatcaggaaaaagtctgtgccgggaggtggaactgtgggttttctgggtgactcgtggtaaatcaggtccctctctggtcctcacttcccccatctgaacagtgggagtgtggtgggatagattcagtgatttcaaacctaacctggtctgaatctctgctcccgactcttcactagctgtgtgaccttgagcagttaacttcacctctctgagtctcagaatattcatctgtattcttatccccattttcgtacttactttacccgactgctgggagtagaagcaggtaaaattcttggaagaccaggcacacagcaagcacccaagcaaagtcagcctcccgaaataataacaagtccacaatgtaacagtgatggctgatgcttactgggcccctccatctaccacatgcctcatctgcacttggtcttcactacagacccgtgaggtcagtgcccttattctccccagtttacatttgagggaactgaggcacaaaagaggagctggcctgagatcacattgctggggtgtgtagagcccagccgaccatggctccctacctgtccccaggtactcatcttcctttcttaatccccaacctccagctgctcttagaagtgttttccaggggaacctggtcttgggagcctggttgggatttcagaaccttggacagctcccagtggacctgggcctcggctgggcctagggccctgggtgtgaggtcctattcagtgggatgagaccctccacctcatcttggccgtgtggaggcagcaggactctggatgagccagcaaagctaagggtcccccctccttccctaggcacatcgagtccactggacccagaggctctttgggaggggaggagccagggccctacttccatgtctcagcacctccacacccctcctgggccttgccatcaccatggaaacaggtggaggatgcactcccaaagaccccacttcaggaacttgggcttgggaagctcaggactaaatttgaagggacctaaagtcactactgcctctgttttccctccagcccattatacaagatggggaaactgaggcctagagaaaggaaggctggattcttgacatgtcccagctggaaggttcccaggtatcagctggccccactgttccattatatagacgagagaactgaggcaaagggaccatcttcagagaggtgccccctgcaattggcttctggaggaatcgctttttttccttcctcacaggtgccataatttgaagcatgtgttgtttttgtgtttggtatctcttctcctgctggtggacaaaccaaggtcagggccatttgtttgtggtcatatcccagggtctggtacacactgtggcagatagagcgttggctctggggccagctggcctaagttcaaattccagcttctgccaaggctgtgagactttgggcaggtcacttctcttctctctcaggctcttcatctgtgaaatgggagaatgatggcatctgcatcccaggcttgttttgaagattgactcagatggtataagcctcaagccttgcctatggcgaatgtacagccaatgtcagctgttactatagtcacctgttagtgggtgcccaggacgtatttgttgaatgaatgagcagaatccacccacctgccccactgtaagggcttttcttcaggacatcaggggctgcctcctcctgatcctattacttttttttttctgagacagagtattgctctgtcacccaggctggagtgcagtggcataaccatggctccctgccgccttgacctctcaggctcaagtgatcctcccacctcagcctcccaagtagctgggactacaggcacttaccaccacaccaggctaacttttttatttttgtagagacagggtcttgctatgttgccctggctgttctcaaactcctggcctcaagcaatcctcttgccttggcctcccaaagtgctgggactacaggtgtgagccaccatgcccaccctcacattttttttcattccagcagacaatgacctctcacctgccttgtcagagggccttgaaatttagcataaattgtaatcccttggagggacttgatgcgaatccctggcctcaccaagaccactgggatccagggctctatgggcagagtccaaggactgacggctgtgggtaccccatgcttgtccgtggctctggcactattgtggctgcctcagggggttcagtgaagaactgtgccatagccattgtgctgaccatgtgggtgacatagccctactcactgttagcaggagctctgccctctgggacaggcactggaagcctaagcaagatgctaggcccagagaggaaccatccgggacactctcctggaagcggtgggtttcagccaggcctgaaagagtgggacggatgttgcccagctgagattggcagatggcattgtggatgggggaacagagcccacaaagtggtgcaggcaggaaaaacaggttgtgcctggtgtgtggtgtgggatgagctggtagatgatatattgggagaagtaggtgggatttatctggattgtcaaagacttggaatgctacatcttatacaagccccttgatttcctctctctgttttccttctgtcacttgagtgttttaggacccatttttttttaattctatgaccccaatttctactcttcccctctactccagttctttcccatcacctctctcctcttaaaactcatgcataccctgacctttcaatctgtttcttatgaagtgaatccatgctgaagtcacagtggccaaaaatgagttgtcacagggctggggaggggtttcttgtaacaggggccttcagtacctcggcccaagacagagacttcggtggtggaaacttgggcagcacactggggacatttgagagaacattgacaggtctgtcactccagtgtgtggtgtgggcatttccagtcttttcctccttcctgaagctttgcctgtgctactccctgtgctgggcactgtccctgccctcagagtgctctgtctggttggggagatgtggtggtgcagggctcccagatctcctgggggcagaacctcaaggaaggctgaggatggtccatcatcagcaaccccagctcccagctggggcctgggccagagggtcattcagaagagtgctgaccccctatgtctatggacttgactagagtcaggtaataggatcagattagaagcaaggctattggggcttagagggaggaaagatggattctttagtgtgtgtggaaggggcagagagagaggagtcagggggcagatggggccagatcatgggccactgagcaccagcatcaacccaggccaagagaagcttgtttgtccattcattcaactagtatttgttgagcacccaccatgtgccaagccctgtgctggggtgctgtggaaaatgaaacatgctcacacaggcttgatggtcagggcatgaattttggcactctcatggaaaagctgtgggactctggctacaagtgacaggagacctcaaaataatgtggcttacaggttgggcaacatagcaagaccccgtctccacaaaaaaattttaaaaattagcccaacatggtgacatgcacctgtactcccaactactcaggaggctgaggcaggaggatcacttgggcccaaaagtttgaggccacagtgagcaatgattgtgccactgcatcctagatgacagaacaagacacttaaataataataataacagcagtagcttagataggatgaaaatttatttatctcccaaatatgagatgggtaggcagttcagggcctaattggtgtctccacgatcattcagaacctagacttcttcaataaagagttgttactgtgccttccatagaatggagcttcacctcatgattcctgatgactgctccagctccacccatcttatccacattccagccatattgcatgtatgacctctaagctgattttcttagaaactgcacctatgacttctgtttatatccttctaccaaaaacgtagtcacatggccacacctatctgcacaggagggagggaaatgtacactttattctagatggccaaaggcccagctaaaatcaggagttcagttactgaagaaggaaggaggagatatggggggacaattagcaatgcctgccatgctgtttcttcatctgactagaggtcattactcttcattcatttatccaacaaatatttagtaagcatttactctgagctatggccaccttttgagtgctgtgccagctgtgaacaaaaaaggcaaagtccttgctgtagcagagcttactttcttttttttttcttttttgagatggagtttctctcttgtcgcccatctcgttctaaagtggcgcgatctcggctcactgcaacctccgcctcccaggttcaagcaattctcccgcctcagcctcccgagtagttgggattacaggtgtgtgccaccatggccagctcatttttgtatttttagtagagacaaggtttcaccatgttggctaggcttgtcttgaactcctgaccttgtgatccgcccacttcggcctcccaaagtgctgggattacaggtgtgacccactgctcccggctgagcttactttctagaaggggaaacagacactaaacaaacaaataacatcaagcagtgaaaagtattatgattttaaaaatcaggaataaagagtgatatggggccaggcgtggtggcttatgcctgtaatcccagaactttgggaggccgatgtgggtggatcacctgaggtcaggagttcaagaccagcctggccaatatggtaaagccccatctctactaaaagtacaaaaaaattagctgggtgtggtggtgtgcgcctgtaatcccagctacttgggagactgagggaggagaatcacttgaacccaggaggtggaggttgtagtgagccaagattgagccactgcactccagcctgggcgtgacagaacaagactccatctcaaaaaaaaaaaaaaaaaaaaaaaaaaaaaaaaagccgggtgcaatggctcacacctgtaatcccagcactttgggaggctgaggcgggtggatcccgaggtcaggagattgagatcatcctggctaacacggtgagaccctgtctctactaaaaatagaaaaaaatagccaggcgtggtggcaggcgcctgtagtcccagctactcgggaggctgagccaggagaatggcatgaacccgggaggcggagcttgcagtgagccgagatcacgccactgcactccaacctgggtgacagagcaagactccatctccaaaaaaaaaaaaaaaagtgagatggatgtactattttaggtgtagggaacgtagcctgaagaggaggggatatttgagcacagacctgaatgaagtaagggacaagccattaatggaaagggggctctgagaagagggaacagcaagtgcaaaggccctgaggcaggagtgcgcctggtttgacagagaaacaggaaggaggccggagctgctgcagcaacttcatgggtcatcgtgaggataaaaagggcgatggatatgacgtgcccagcattcatcctggttgttcaacagataaggtacccacatgtcatgatttgcccggggcagttctggagtaattactaacagcttccttttcaagctcataagtatccctgttgggatgataaagtatgtggtcatcacatcaataaataatagctatttattgggaaactaaattccccaaggtatttccgggaaagcagcatcgccgcgtcccaggggatgggctgtcctcccctgactgccatatactcccaacccctgccccgtgtttccgccctgaaggagcagccccatcaggcacagctgtgctgatgccggcccctcatccccacaggctcccaagcaggtgagtgcaccagcatctcacagttcccacatttttagcctgtgggtctcaagcggcttctggtgtccctcagacatgtatctagaggaggtgccatggggacaggacggggatctgcacagggacccagaaggctggcgggtgccaagcctggatcgtcccccgagctcagcttgcccttaggccccccagcccttcggcatcagtttctctttgtgtgctagagacagtttccttgtggatatagggtagcggatgagtagcccagcagctgtgggaggcgggagcaagtgcctgggtgagagcagtccctcctgggtggggcagtggggtcctgtgaccttatccatccacctggccctgaggaggccccttctccatccccagcacctgccccatcctgactccgctgacactcagaattcaacttccttcaatatctcaatttgcaggtgcttaatgaaaatgcatgcctcacttccctggactgtgaaatgggcctgatagtgtccatctgtcatttccctggggtgaatcagatgatacaatggctgacaagggcatgccctctgtaccagggcagcaggtggggaaggggcctatcatgacctcctttgttccaaaaagtatcagcccaggcctctgcacacagtaggtgatcacaaagtgcttctcacagcagatggcagagatgtgatgtgtgctgaggactgctgaccagtttggctcagtctcccttttgcagatgctggaggggactgtccctcactgcctgactccttccccagtgggctgtgggcctctgctgccccagaggctgcttgtgattgggggaaggagggctgtccctgccagcaccacaagcccctcactctggaatcccaaaggcctagggagtcaggtgccacgccggggcagctgcattgttggttcagaggtatctgtgggcccagacacatctaagctttaatctcaactccagcgtgtgccgcctgccctccggcgagtgacttcacctctcacaacttccagttcctcttctgtgaaatggggatcgtaagagaggctgctccaggagtggttgggggcccccctgcctggcacagaggagggagtggcacccactgctcccactctgttgggattactgccatctttgtgccatcttttctgggagggcaagacctggggtgtcatccgtacttataaatggcagaccccctacaagaggggtccccaacccttgggccatgaccagtgctggtccgtggcctgttaggaactgggctgcacagcaggaagtgagtggcgggcctgttagatccacctcctgttagatcagcggcggcattcgattctcataggagctcgaaccctattgtgaactgcacatgtgagggatctaggctgagctctccttatgagaatctaatatctgatgatctgtcagtgttgcccatcacccccagatgggaccatctagttgcaggaaaataagctcagggctccaactgattctgcgttatggtgagttgtataattatttcattatatattacaatgtaataataatagcataaagtgcacaataaatgtaatgcgcttgaatcatccggaaaccagcccccctcatctgtggaaaaactattttccatgaaaccggttcctggtggcgaaaaggttggggaccactgccctaccagacagcagggcaggtgcaaggtcacagtctttgatttgttcgatggatatttcctaagcaattactatgccccagacactgtgctgggggctgcagatgtgttggtggggaagagaaacaatgtctccccacctggagctcgctttagaaatgggggctcctccaaacccacctgtgggtgtgatgtgctgccggccgggtggtgtgagtgctaagaggcaaaacgaccaggacaaagtgcgaggaagcccaggcaggtgagacagggtgtctggtctgggtccaggaaggcctctctgaggaggtgacagctacagaagctcaggggaatgagggagggagagaaccccgggtgatccagggaagagtggtcctggcagcggaaacagcaagtgcaaagggcctggggtggagcagctgcaactgaagaagaggtgggaggccagagttggggaaggagggcatgatggtgagagtgggcgatggcagagacgcacatggggaccagaccttgtggggccctgtaagccagggtgaggtctcagcctccactcagtgagatgggagccactgagggctttgagcagagactgtgtctcaacaggactatctggctgcagtgtggagactggactgaagggatcatgagtgcaggcagggaggccaaggggcctctaatttgggggagaggtgaccgtggctgggactcggtggcagaggtgggggtggggagggccggctggattctagagatgttttgaagggaagagaagcaggatttcctggaggactgagtgtggggcgagagagaggagtccaggaagacgggaaagtttttgtcccgagaaaaagaaactagagctaccctcaagtgggatggggaaaactacaggaggagcaggttcaggagaggaagggaaggcggtgaaaattgtctgataccttgtagacatccaggtggacaggcccagcaggcagtgctgcatggagatgtctagagtttgggggaggccaggctggatgtgccagtgagcaggataggaggctggaagggtcgccagggagtgagagctggggtctcttcaggcagggaggtgtgggtgacgggaagcatgtctgctgaactgaaagtctagatgttggtctgagttataaagacataaagaacgggactcttgctgtcataacatccacaagaggggggctacggaaatgagtggctgctcagcaggcccaggttctgcgctgccctcacctcctcctgcgtccactgtgtggccttgctaatgcacctgccccctctggaccttgattccttgactctggtgaatcatccttttggcatctcccatggagatgctggggcagcctcagagacttcaggtggcctagaaccatggaaaatggggagaaggggtggccaggggtacccgacgagctcagagcagagggtggggagaaagctgggcctgcagagcggctttcctggaggggttttagacagggcagccatggctcagagagaggaagaccccctccaacccacactgccctgcggcaggtcctgctgggatgactgagagggggcggctctggcaggagtcacacggtgacctcagctgtccctgaaaagtggctgagtcagcatctgggctgggctgggcttcagtgcccaggtgcgtcttctccatggccaggcaggagagggaaggccccttctgctgtctccccagccctggggccttttttctgctgctgatctttttgaggactcttttttcttttcaccatgaagggcagaagcatttcttgtaagcacctggttacaaactcagcacatgcaggccacagggggcccaggagccgtacagctggggaagctgaggcctggtgctggagagagacttgccctggtcacaagagttggaacagagctggggctccaacctgtgtccgccactttgccattcagaactctgaggaacttaggggaccagcggaggaagaggagccggcaaaggcagtgagaagttgcagcagctctgatgactggcttggcccaaggggcaggaggccacacctgccaggggcttcctatagatccagttctgtacagaatgtcctgtgtgctcctgtccacagctgtgccatcatcatgtccatctgagtcagagaggttgagcgtcttacctaaggtcacccagcaaatgaggggcagaagtgggtttgcatccaggtcagctccctcgagcgcctgctgtttccccagctgccccttgacaactgtggagaacaaaacgggaggccagcaggggtcaggtggggatggccgtaggaaggacagagttctgtgccggccggcctcccgcctcaggccacattctctctgggggacttgtcaactccactggtgtccctctgaacacccacagtccccatacctgcagctccacccctggcctttccctggggttctcctggaccgcattcccaatgtcctgattgagcccaggagttcaaagctgccgtgagctgttatcaccccactgcactccagcctgggtgacagagccagaccccatctgtagaaaacaaaacaaacaaaatcaaacaaacagctttatttgagtactgtttacactccataaaattcacctattttaagcattctctttaatgagttttaataaatttttgcagtgcacaacaaacaccgcaattcaaaagttccctctgtccatttgtagttgctcagcacatccggactgactcctgcatttgtccataggtcttctcttgccactctgtcccctgactagtgagtggcactatctggagttgaccctcgtggctgcacccaggatcccctcactgcatctccactagcctttttaaaaaacagctgtattgctgggcacagtggcttgtatctgtaatccctgctattcaggaggctgaggcaggagagtcacttgagcctaagagtttgagaccaacctggacaacatagtgagacccccctcatctcttaaaaatgaaaaaagaaaagaaaaaaattggccaggcgtggtggcgtgtgcctgtagtcccagctactcaggaggctgaggtgagaggactgattgagcccaggagttcagagctacagtgagctatgatcaccccactacactccagcctgggtgacagagtgagaccctgtctacagaaaacaaaacaaaacagataaaaacaaaacagataaaatcaaaacaagcaactttatggaagggctgtttacacgccataaaatccaactattttaagcattctctttgatgagttttaataaatttatgcaatgtgcagccaacaccacaattcaaaagctccctctgtccatttgtagttggtccccactcccacccctggccccaggcaaccactgatctgctttgtctctatagttttaccttttctaaaaaggaagtaaatggagacatataacatgtagtcttcacgtctagcttcattcactcagcataatgattttttttcttgttcttttttctttctttctttctttttttttttttttaagagacagggtctcactctgtcttccaggctggagtgcagtggcacgatcgtggttcactgcagcctcgacctcccaggctcaacgatcctctcacctcagcctcctgagtaactcggactacagatgcatcctaccatgcccagctaatttttgtggttttcgtagaggcatggtttcaccattttgcccaggctggtcttaaactcctaggctcaagcagtcttcctgcctcagcctcccaaagtattgggattacaggcgtcagccactgagcccagcagcatcatgtttttgatgttcatctatgttgttgcatgtatcagtgctttattcctttttagtgctgagtaatattccattttatggacattccacattttgcttatctgtttgctggtcaatgggcatttgaattatttccagtttggggctattatgaataatgctgctatgaacattcacgtacaagtcttcatggggacatatgttttcatttctcccatataacctcccttttccatcccaccagaccttgattcctgttgaggagccacacagctgtagggaaactgactccacccctcccgtgaggatagagctcaggccccagggtaagccaatgggcatagagctcatgacccaggctaggccaatcagtgtgttccatcctctaggcctgatgattggttcctggatgggcaagtgagataggccagtccaatcagagtgactcttaggactggcgctggaacagctgccctttttcatgccccttatagtatgtttgttaaatctggagcagacaccctgtgtgcattagcaaagccagctttaggatgtaattgacacatggaggaggacagggctaagaagcttgaaccctgattcaactgtgcctgaagtacaccacaaatccagacagttgcatggatcaatcaattcactttatcgttaaagccagcttgagatggtttcattgtttttgtttgtttgtttgtttgtttgtttgttttgagacggagtctcgctctgtcacccaggctggagtgcaatggtgcgatcttggctcactgcaacctccgcctcctgggttcaagcaattctcctgcctcagcctcccgagtcactgggattacaggtagctgccactatgcccagctaattattgtatttttagtagagacgaggtttcaccatgttggccatgctggtctcgaactcctgacctcaagtgatccactgcctcggcctcccaaagtgctgggattacaggggtgagccaccgcgcctggcccgttgttgtttttgtttgtatctcaggggtcagcaaactatggcctatgggcagcctgtttttgtaaaaaaaaaaaaaaaaaagttagaacacgccacttactaatgtattgtcaatggctgctttgcagtgccatatggcttgcaagcctgaaatattcaccatcagccttttaagaaaaagtttcaggcccctgttataaccaaaagcttagtattcagtatatcccccagtcatcaggacagaaatctgggaatcatccctgaatcctccctctacctcattccccacatcaaaccagccccaaattggattgattttttagtctacgtgtctcctgaatctgtctgctgtcttcaggccccagtatcctaggtgaaccattgtcagctctcgcctggatctcgccacccacctctagactaccccacaaagctgctgggtgatctttctcccacacacatttgacgaagcctccattgctcccagggtaaaggccagactccctggactggcactgcaggaccctcgtgagcgagcccccacctgcatttccagccccgtctctcccctctctcctctcgtcctcccccagagcacacagaccagcacctgacttgtgcagaagttcccaaacatggcgtgctctgtccctcttcccgccttttgtaccagctgttccttctgcctccaatgcccttcccactttgcccacctagtggacacctgtgtatcctctaaggcccagccaaagcctcgcctccttttttgttgtttctaaaatcaccccaacctgggtcagggctcccataagcccttggggctcaagaagtgttggtttgcaatacaatatttctgccttttgctgcaaagccactgtgaggaatccaaagaaggtttgaacaaggcagggaggaagagcatggctgtggactgtcagagctcggtgtgaacaaggggacatagaaggactggaactgcttgagtttccaaggcccaaagaccccaggcaggagcatctttaggaagtgcatagaaatgcctcctaagatgaacaaaatgaaccaacgatgaggtcggagaatggttccgagaaaagaaaagtagggcaggtgagagtgggccactgtggcaggccctgagagtgcggaatagaaacaaagggattacagggaaatgtcattaaagtgaagattttccacagactttggaagtcagcaagtgggacgggaggagaccagatggccggtgagggggctgcggatcccgtcggaaagtttaaggttttacaagactagccctttggagggcttagggaacatctgacttctaggttctcaactgaaaataaatttgggtaccagctggctgggtcctgagtgaaccttcccaagaagcaactgtggtggattcaggggagcactggacagggagtccgagccagctctgctgtcactggctgtatggttcttggctgccatgtcccggggtttagggctgtggcccatactcactgctaattctggaagtgaatccaggacacagaaaaccagaaaccagtcaaggcccgacctcccccatggggccacagtgaggcacgcatgagacagtggatatgaaaatgcaaactgcagtgcggtggccccacatcactgtccctcctctcactcctccagctgagtccatccccgtcctcgtggctccccagctgatgcatgaacctcactcttacgctactctgttgtggaacataatgtatggcacatctcttctcctgtcagaccctgagtacctgaggacagggacaagcatgttgggctcctgtccccaacatgtgttgcagtgcctggcccagagcagggattcggcaactatttcttgaaggactttgaattgtaaagaaatagttaacttggctgggcgcagtggctcacgcctataatcccagcactttgggagactgaggtgggcagatcacaaggtcaggagatggagcacatcctggctaacacggtgaaaccctgtctctactaaaaaaatacaaaaaattagccgggtgtggtggtggacgcctgtagtcccagctactcgggaggctgaggcaggagaatggcgtgaacccagggggcggagcttgcagtgagccgagatggtgccactgcactccagcctgggcaacagagtgagactccgtctcaaaaaaaataaaaaaaagaaaaagttaacttgaaggtgctggtcagcctcagtttataaaagcaggaaccaggtagatcatggtagaaatctttctgacaaattgacaaaatgttttgtgagtttttaaaaaatatgagcatgccagaaatgctcaagaagaagtggaactcaagcagttccagtccttccagtctgggattgagaatgctaaaagctacctggccctgagctatccagtagggtaaccatgagccacatgtggctattgaacttcaaattaaatttaaaaatcagttttgtattttatttaatttttattattattattttttgagacagagtctctgtcacccaggctggagtgcagtggcacgatctcggctcactgtaacctccgtctcccagattcaaggaattctcgtgcctcagcctcccaagtagctggaatttcaggcacatgccaccaccatgcctggctaatttttgtataaaaatcagtcttttaattgcactagtcacatttccaatgtgcagtagccacacgtggctcacggccaccctatgggagagtgcagattagagcatttccatcatggcacaaattcttttggacagcattcctccatgccttgaaaatccgtgcccatgtgttattttaagccctgatccttccgcaggggcttctgagacttagggagagatctggggctctggaatctgacccagagttcgaatccctgctcagccatttgcttgctgtgtagcctgaggcaaaggaacttccttctcctttctgaggctcggtgtcctcatttgtggcctacacaaagctgtgggttcaaggagaaagctaggtaaagggcttcccagttggtactgcgtgcaaggacctgctatgaggcacatagcggtgttcctagagctgtgagagactgcacaggctgttcctatcagaacattgccggaggggacgcctcccaggcccttgcagcttggagccactgcccaagcttctcaaaatgaggcaaggcatgctgggagttcatcgggcactgggggctgatctggagcagtggccagtgggtgtgactggcttggagcagttggtaggtgaggtcaaggctagaactggtaaggctgggaggaagggccagcccgctgaatcctgggtaggggcatgcgtcctctctgcataaaactccattgtctactagctgattaggggatcataatacgaatacaaggagtcatagcagctttatactccttgaacatttcctgtctaccagacactgtgctaagagatatactatgtgtatgcattagctctgccctcacagcaaccctttgtaataggtatgttattattcccattttgcagacagggaacactgaggccagttgtccaaggtcacacagctatgaggcggtagagctggtatctgaccccaggctgtttagctccacagagtcaatgctgggataaagtccagcccctgacccggtcctccaggccgtgtggagccagcctcagttgccctttccaccttcatctctgtcactcctcatcttctggtcaagttcctcagacatcccaggtgtctccctccaatgtctgtgcccttgttcacactcctggtcccctccagcctctgcagactcctgttcacctgccacgaccccgttctggtgtgtgagcatcccgaggctgggaatgggtttaagttgttttcatgtcataaagtcctgcacgtggcttggggcgtcagggccatggcgaattgtgggtggcggcttggtgggtgggtgatgagtagctggaagggtggggggagtagatgaagggtgaaccaaggggcgggtggacagactggtggaagagtgggtgggtggcatgtgctgcagtgccctcagtggggcggggcctgagcagagcatggggggctggacatggggagggatggcggcagggaggggtctagggtgatgcctacttttctagcttggggtcttgagtgaatcatggtgtcatcagggcagggtgggtttaggggagaaggggatgaggtccattttggacatgggggtgtgacgggccaagggttcaggaggccgctggggagatgagcctcaggttcagaggtgacctcgggctgcacagagagactcgggaggtcagtatgggtggtgattcgagtcgtgggggccaatggcgtcaccacctgggagctgggcatggggtgagaaggactcaggacagaggaacagccacatctcagagccagcaaaggagggggaagaattatagtcccccagatagaaaagccaggagtgtcagagcaacagaagagtcttgcggagaggagaaacaaggtgttgggggtgtaagaagcccccagggcatgagggaactccgtcagtgctattttaaaaaaactatttttccatttcagttcaactttacaaatatttattgagctaaaaggttctgtgtaaatccattttgtaaattaaatttttgtgcaacaaataccattttaactgggcctgaggtggcaaggtttgggagaccattcattattcgaggaaccctgagtcgaattcttttgaaaagctttgtttggtttgttttttgtgtcagcaaggattttggcttttcaggcttgcagagtgaggcgttcatttgttccacatgcgttttgaaaagatccttctggctgctgcagagaagatgggccagggaggcagccgggcacctagggaggaagctggtgcagtgtccgaacaagagatggtactggcccggacgggggcgactctgggggatcaaggggaggggatttgagggatgtataggaggttttttaaaaagataggacatggcctggcatggtggctcatgcctgtaatgccagcactttgggaggctgaggcaggtggagcacttgaggtcaggagttcgaaaccagcctggacaacatggtgaaacccccatctctaccaaaaatacaaaaaaattattagcggagcgtggtggtgcatgtctgtagtcccagctactcgggaggctgagacaggagaatcgcttgaacccgggaggcggaggttgcagtgagccaagattgcgccactgcactccagcgtggatgacactgcgagattctgtctcaaaaaaaaaaaaaaaaaaaaagataggacattgccagccatggtggctcacacctgtaatcccagcactttgggagactgaggcgggcagatcacctgaggtcaggagttcaagaccagcctggccaacgtgatgaaaccccatctctagaaaaaatacaaaaattagctacttgggaggctgaggcacaagaattgcttgaaactggggggcagaggttgcagtgagccgagatcacaccactgcactccagcctgggcaacagagtgagactctgtctcagaaaaagaaaaaagaaaaaaagataggacatagtcttgggctttacttctgggtgagtgaaagaggagaaggaagaagaatagaagcctcctggcttcttggtcgcctgagggtgaccaggttagatgatactgggatgagggcatggtctccagggaaggtcacagactgggccctgtacacatggagtacacagtgtctgtccacagatggccagcagagctgctgtaggaatttggagctcagaggtgtgagctgggctggaaagagaaatgtcacatctgcgacaaggaaggagggaaaacccagagctcatgacagttggtcaaggaatatctccagtattgaaaatatttgttcaatgaagtattcacggagcacctccatgtgccaggtacagcgtgtggcaatgaaacagacagaactctctacccttcggggctgacactttagtgagaggagcaggcaatgatcaggataaattatgcaattacgtggcctgttgtataatgatatgggctgagaaaaacaggaaagcaggcagggacaggctcagggaatgtgctgtggagggctggggagtgtagcagacacacaggtcacacttgctgaattcatttgagcctcacaaccaccatatgaagaaggctctataactacccccatcttagagatgagcagctgagttgcagagaagatatttgcccaaggtcatgcagccacgtaactggcagagcctggatttttacttggagttcatacttttgagtcctcctgctagggtaaaactccctctcaatgacaagatcaggtctcagcaaagattctgaaagaagtgagggggtaaggttcacagacatctgaacacaatcaacattccaggcagagcaagagcacgtgcaaaggccctgagctaggcacgtgcctggtatatttgaggaacagcccaaaggccagcatagctagggcaaaaggagcaggtgggggagggaaccagaggtggtgcagggctgcctgtggcgtctgcagggctgttagcttttacttgaggtgcagtgaggccatggggagtgtggagctgaatacaaggagtcatagcagctttatactccttgagcatttcctctggcttctgtgctgggagcaaggtcagaagcaggacaccagagagggcatgaataatccaggcacgaggtgacagtggctcggtccacagcggtggcagcagggtggggaaaggaggaccggtggcactgctgatggcttgcgtgtgagaggggagggtgggagagacctcaagtttggcttgggcctgagtggctggaagggcaggattccattgactgagatgggggcagctgtggaaggagccacttcataaagaactttccatgtccatttccctctgaatccctggctaccctgaggtaggtattgaaacttgagcagttccatgatttgcctgggattgcttggctggaaggtaatagagccagggccagaagccgtatgtgcatcctagggtttggaattttgtctcatttattcaatcaacaaacatttctggagcacctcctgtgtgccaggctgatggaggaggctgtgtcagccaatgatcgtggcaatggttacctcacatcagcatgagcagtggtgaggagaagccgagggagctctaggagccagtaacgggcaggagggaagggtgctgcagggccagggagggcttcctggaggaggagaatatgacatacaaggaccacaaaggaccacaggttcccagaggataactgcctattgggaagttgcagaatctttttgttttgttttgttttgttttgtttaagtgttaataattgagatatagaagctgagcatggtggtacacacctgtagtcccagctattcaggaggccaaagtgggaggaccctttaaggccaggagttcaagagcagcctgggcaacataatgagatccccatctctacaaaagttaaaaaactaacttggtgtggtggctgatgcctgtagtcccaactacttttgaggctgaggcaggaggatcccttgaacccaagaatttgaggccaggcctgggcaacatagcaagactccatctctaaagaaaagaaaaagaattgagatataattcacataccatacaactcacccattaaagtgtatagttaatggcttttagtatatttacagggttgtgtatctgttaccacaatccatttttgagcattttcattacctccaaaaagaaaccccacaccccttagctgtcaccatctctcagtccctgtccccacactgggaagcctgaggcagcccagatatactttccgtctgtacagtggcacctgttctggatatttcattgaaatggagtcatgccatgtgctgtcttctgtgtctggcctcttccacttagcatcacatttcaaagttcatccatgttggaagctgcagaatcttcaacagcatcacagatggcccggacccaagagactgtataatggtgcttcccgaccattataaagaagtggggccaagctcagtagctcatgtctgtaatcccagaactttgagaggctgaggtggatggatcacttgaggccaggagttcgagactagcctgggcaatatagcgacatttcatctctgcaaaaaatacaaaaattagtcaggtgtggtggtgcatgcctgtagtcccagctactcaggaggctgaggcaggagggtcgcttgagcccagaaggtcaaggctacagtgagctatgattgcaccactgcactctagtctgggcaacaaagtaacactctgtctcaaaaaataaaaaagaagaagaagaagggggaatcaaggaggagacttgccgttctgtcagcaaggaagaggtggggaatttgaggaggcctcgggcccctaggccagggccctgcggcaccctgccgtgctgggcacaggccacctcccttggttgccacttcttttccttcagctttgggctctgggtgaatttggctaaaagtgacaactcggtcaggaacgcatcttctcaaacaccggtctttcccgccctggcaattttcacaccttatggtgaatcttgaaatcttttatgcatcttcgagaatttgtgtctactgactcagaatgttttggggtttgtattttctttttctgctccttaacacttttattcaggtggctatgcctgtttttcttggtttggtgatgttgtccctgggggaggctgcatcgtcctggagtcaggtgcctgggttggaggccctgccctgcctcttcctgggtgtgtggttgtcgaagctctccgtgccttggatgcttcctttggaaaatagagatgacattgtaaggctgtggcaggaaggaaatgaggtaaagcctgttacaggtttggcactgagtagattctggaggtttggttcttgatcagatgctaaggagagatggtgaggcctttcagggccctgagatagcaaggggagaaaggtgagcctccccgaccagcgactgtccctttctccttattcctcccatcccagagccccctagacctggacctctcctctcagggctcagacgtggaaagcctgagttcaaatcccgacctaccactcgggttctgtgtccccacaccagctaggcttcttctgtgtctcagtttcttgacctgtaaaattggaggggagagggtggagggtgaggggagggtgttccactgaggcctccagggcagccaaaaggcttctgggaggggtgtggaatagaggggcctttttcttctccctagaggactggttcctgctgattcgtgggttttttgtttttggttttggtttttttgagatggagtcttgctctgtcgcccaggctggagtgcagtgacaccatctcggctcactgcaacctctgcctcctgggttcaagcagctaattttgtatttttagtagagacggggttttaccatgttggccaggctggtctcaaactcctgacctgaagtgatccacccacctcagcctcccaaagttctgggattacaggcgtgagccaccgcacccagcctggttcctgctgatttaaagatccaggcaggagcagtgacacctgttcaggggaagtgggtggagagggacacctggcttccctccgctctcacacgagagtgccacatggaggtggtgatgcagtgaagggcctcttagaagggcctttattgggcttatttcacctgcactgtcttctcagtcctcacagtagccttcagagaaggcactcttgttcccatttggctggtggggaaactgaggctcagaaaggggaagctgcctccctggtgtcaccccgcatgtgagaggctgagctgggatttgaactcaggactgcatgactcctacccctttcccaacttctcccatccggggaaaaggaggaagaagcaagacagggaaggatttgagactttggaacccagcttcccgactgctgtggggattctgtgggtggtgggaaaggcactgtaaatatgcatgacatgcaaatttgcctctaaaaaaacaatgtgggtgctcacatgagccgggatgccagggtgctctggaaaatgtagtgttgtgcaaacacttgggtttctatgaccactgctccatgtcgtctccttccctcgtgtccccagggccagtctaagggtctcaggtggagggcttacctccagcacctcctaatcaccattcctccccattcctgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggtaagtaactgcgtccgcaggctttgtctcctcaccagccccccatgcttggcacagttgggaaatgcccagcctcacttccactggcacccacatgctggcagagggacctcagtcagagtttgtatatgtctgggcaccatttatagttcaatggcctgtcttagccagtcctcccaacaaccaggaggtgcgtgtggtgatcacgcccattttccagaggagtcagcctcagagaggggaagccacctgcttggggtgcacagcaagcccagctctgtccacctcaaaggccagctcttgccacacccaagcaggcggggacaggttgtgcacataggctcaggacaggaagggagccatgagctgtgctggaggccatagaacctctggggcccccagggcggcttgaggggaggccatcagaattcttgaatcttggggggccctacattcctgcccctctggcctgttctccccatgctcctccagctcccactttgccatcaggatgaggtgctgggcctgccccgtctccaaccgtctgtctgggggtgcaaccacagtgccaccacttcaccatgctgcttgcatcttttcttcaccttccgcctcccaaggctctgctggcataacaatctagttcacagatgaggaaacagaggctcaaccaggtcaagaggcctacgtgcaggctcacccagccaccacgaagcactacatggggccactggggtaaaatctgcctccttctctggccttagctctgcaaggacaaagaacaaccacttcattcccttctggccaactagcagctggccccgtgcctggcatacagtgggtacccagtaaatagctgtggaaggaaggaaagggggagagaagaagggaaacctctcttacctccctccacccagacaccagcaggacctgagcgcctcctggccttttggccagtgccagtccctgctgccccagatggcttgcggtgagcccatgccctcagcaaggtggccagcccctctggtcccaattctctcatctgctagagcctgcccagcttccctgatgggatggttatgagaagggaaaagattcgtaaatatgtataatatgcaaatgtaatgggatcttttgtttctttaacccttgaagttcactgtagataacgtatgtagaagtgcttctgtgagaacaaggagctgcccgctggggtggcgccagccttattatgactaaccatgaaaagggccccattaattagctgccccacaacctggctctcccgacccagctcctagtctgttgttgcggctgcaaatagccgttgcttttggctgagaagctggtgcaggacaggtgataaggatggcttggtctgagagctgtgtctgtgggatttaatcatttgcaaacacaccttattgtgctcaaggaatgcaagggcctctccagggactaaatgtgtaatgagggccagctgaataacagcaagcatttcttgagcaattactatgtgtttggcatcgcactaaatgctttgcatttttcgttatttcaattaaattcccccataaccctgtggaaggtgaagggggagactgaggcagggacttaggggtgagggctcatctgttaacagccagcatttcctgaaaattactgccatccagtgcccacctccaccctccgggccaggctctgagaacgcagcagagcagacagcccctggcgtgtgtggcccagtgacggagaacgggattccttggcacgagctgggtgagcagccgtcagcatcgcgtggaaagatggaggcccgggcggcagcgagggaggtgttactgctgctattttgctaacaagctggttatttaaagaacagccgaagccggagctagaaaatgggatgaggtgtctccagggcagaggcagccaggagtgctgggtcctgagacccagagacctggttgaatcacagcagagtggccacacagtcatttattttttttaatcaacttattaacatagtaatggctgccgggcatggtggctcaggcctgtaatcccagcactttgggaggccgaggcaggcggatcatctgaggtcaggagttcgagaccaccctggccaacatggtgaaaccctgtctccactaaaaatacaaaaattagccaggtgtggtggcaggcgcttgtaatctcagctacttgggaggctgagacaggggaattgcttgagcccaggagacagaggttgcagtagccactgcactccagcctggccaatggagccagactctgtctcaaaaaataataaaaacaatagtaatggcaccataaaggctggacaaggattgccttggtggagaaaagaacattgggaagggaacctcagggggtttctgaggggccagcagtgacctgggtggtggttacatgactatttccttttgatattttactgcagtaaacatttttgttttgtgcactttactctttctattacatatcacagtaaaacggctaaaaaacaattgtaaaaataatagctaatgtttattgagcacttactaacaggctgtttgctaagcattttttatctccttgaatcctcctggattcttttattctgcccattttacagaggaggaaagtgaggcttggagaggtaaaactacttgtcatgctgccaaagagtggaggaggtgagatgagaaaccagacagactgacttaagcctcatgtgcaaggatcggggtccaggaagttccccgcaaagggccagggactcctccattttttcctcagacatgtctgtgcctcttctatttttaaggcttgggaggccaggcaggtgtgtgcagtcataggcagcagatgaggagcctgggggtctccaaggggacagagcagagcatttagctgtttaacaagtatcaaagagctgggtgcaatggctcatacctgtaatcccagcactttgggaggctgaggcaggaagatggtttgagcccaggagttcatgatcagcctgggcaatatagtgaaacctcatctctccaaaaaaaaaaaaaatttaaatagctgagtgtggtggctacttgggaggctgaagtgggaggatcacttgagcccaggaggcagaggttatggtgagctgagattgcaccactacactctagcctgggtgacagagtgagaccctgtctcaaaaaaaaaagtattaaaggataggagtgggacgttcctagggacaggcctggggagaaggccaaggcatactcaggtctcatttaaagtaataaaagaggtgggagaatggcttgaggccaagagttcaagaccagcctgggcatcatagcaagacccccttctccaaaaaaattaaaaaaaaattagccaggcatggtgatatgtgccggtagtcccagctactcaggaggctgaggtgggaggatcacttgagcccaaaagtttgaggctgcaatgaagtatgatcatgccactgtaccttaacctgggcaacagagcaagaccttgtctctaaataaataaataacattaaaaaatttttaaaggtaaaaaacgccatccaggtgagacagggtcagacccacctgtgaactcactggatggggggccaaactgcaattttctgaggacctattttgtgctaagcacatttgttcccttctttaatcttcagaacaaccttgtgggattagcagtattggccccattttacaaatgagaggactgagacctaagtccacacagacagtgggtagtggagctgctctgccagactccagtgccttgtatcctgtgcgtgcagaaagccttgcttggtgctggggtccctggcagggcaggcatctgggcatagatgctccaagcagcacatggctggaagtgagttccaaggcagctctgtggggccctgaactgacactagggacatgtcatggagcggggtagtctgctatgctgacggagcatctcttcattcatgcgttccaaggacatctcttgagtctagtccctgctagtccacacccttcctggagcacacaggcttggggagggacagatattatacagtcacccaaagacatacacagaatgaggagagactccattggtgcagtgagggaaattaacgtggtgacatcatgaagatgaaccggtaggagacctgtgtgacatggcactgtccaagatggccctctctaaggagatggcacttgagctgagacccgaaaggatgacgtgcatccagccgtgctggacagtgctcatgtaacatcgttgctgttagcaggacaactggggacaacccatttgtccatcaccacgggaccagttaaagccattttactgcagccacaccgtggcgcctgctacagctgttagaaacggggccatggagctaaatttattattgcataaagaacttcatagtgtgtcgtagaggtttttgtttttttttttaaaaagaggttataaaacagcatgggtagcattatatcatttctgtaagaattatatgtgtttctggaaactgcacagtgctcttcctgggaagtgggggcatgggtgatctttgcttcttctttctacttttctggatttggagtctttcctgagttttaggacttgtggggaggaacagaggattttagggttcccaccatcttgcctagggtacttcttctctcctgctacccacctcaatgggataaggcatgggctggggaatcagcagatctgggtcatccctttgactgtgtgaccttgggcaagtcactggccttctctgaggctgagtttcctcttctgcaaaacagataagaatagcgtccgagggtaggtgtgggcttaagtgagtagaaacatgtggagggctagggcagtaccaggcttgcatccctgacggtgctgctgctgttatgactgtgactgctaaaggtggcacctaccgtgtgtcggcttgtcctgccagggctccccaggcttacctctccctccgtcactgggagtcagacccaggtaggagacaaggcccagggtgggctttgtcacattgtcagcttggctgggcacaaggccagctggacctcaggtcagcaccaacccacaccccgcctctctccccaccacctccctccccatcacctccctcacatctgccagtgagcatccttgctagataagctgtgatggggacaccctggcccaggatttgctttttttttttttttcacaactagtatacctgcccaggaaaacagatactactttacagccactaagagaatcttaaatctcaggcagaacaacgtacactcgtgaagtcaaactctctgaatcatggaatcttagtcataaataatccggcaactgcaaacatatgcattttgcaagtaagttcactgcacctttcttgattacagtgataaattagaaacgacccaattctctgtttgtgagagttggttaaataacttacatccggccaggcaatgccattttccgcagctatagaaacagtgctgtaaatctctatttgttgacatggaaacttgtccatggcgcattgttggggaaaaacaggaggttaaaaattgatgtatgttgtgtgacatccggatttggaatctttcctgagtgttaggatttgcagggaggaacaggatatctacttaggtatctactgatttttttttcacttttgttatgaaaaatatatataaacatatgcgtgctcctgcctagggagatgctcagaagagtagtcattaaactgttgatagtggcttcctctggatggtgagatataggtgagctctattttgatttttgtttctatcattcagagttttttcaagtaaggtgatggaaaacccaccccaaactagtttaaacaaaaaatagattcgattgacttgtaactgtaaagttcagaggtctgatggcttcaggctcagctggatccaggacctcagggccaccaggacttgatttctgtttctcaactctgggttgtttccatgttctcattaagctctcatgtacaggtaataagatttctgtccaaagaaataagcaagaattcttccctgattgctcaaacacaagtcccagaactaagtcttggccttgatttgtcaaatttgtgggatgtgcccacccctcaatcaattgctgttgctaaggagaatttggtgctctgattggcagcctgggcctgtgtaccatccaccaccagctgggggtggggtcaataccactggaacctcaagagtggagagtggggaaaagtggcttccccagaagtagatgtaggctatgacctaaagtagaccaaatggtagccaaacccagcaacccccacctcctgtaattatctgaattgcccaagatgcatggttttcaaaatcagaaaaaaaacaatgcaactattgaaaggagtcctggccaggtgcggtggctcatgcccgtaatcccagcactttgggaggccaaggcaggcagatcacctgaggtcagacaggagttcaagaccagcctggccaacatggggaaaccctgtctctactaaaaatacaaaaattagcccagtgtggtggccagcgcctgtaatcccagccactcgggtgactaaggtggaagaatcgcttgaatgctggaggcagaggttgcagtgaaccgagatcgtgccactgcactccagcctgggtgacagtgagactgtctcaaaaaaaaaaaaaaaaagaaaaagaaaataaaggagtcttgaacccagatcttacggtcagaagctcactgaggcagccttcgactttcctggagtcagaacattggaatttctgaagtaccgatttcactagggagacatcaaccctctctgtcctgccagggagctgtcctggccctccaaatgactgcagtctttggaggagaggggagcacatggatgatttgtctggaatgtgagaggtgctaaggtggatgtgcatataggggctgtgggaatgaaaaggccagcctggggacaaggaagaggcttcttggaggaggtgatgcctaaactgagtagccaaccagagtgctggaagaatgttgtaggcaggaaaaacaatgtgtcaaagtcccagagcatgtggtgggagtgcaactataggatgagaggaggcaggcccggaccacaggggccttgaatgccagggtaagaacttggacttgatcctgaaggcagtggggagcctttgggggatattgtgggatgaaggaagtgtcagtgagctcactctgccttgtgctggaagcatagcctggaggagttagatcaaggccccacatggggaacgagaaaaaggacccaatgcccctcaagggagccttagatatctaatggtctaaattccttcccaccctgagtcagaattcctgtcctgagatgcccagccactgcttgcatacctccagagat
